United States Patent 10,767,156 (POLYNUCLEOTIDES ENCODING BREX SYSTEM POLYPEPTIDES AND METHODS OF USING SAME) - sequence listing, part 12

SEQ ID NO: 6220 - DNA, 5248049 bp, Desulfovibrio magneticus RS-1 (residues 1,749,351-3,498,700 of 5,248,049)
ccggaatgtagatctgcccttccatgtcgctggaggtgtgcacgatgcgcaggcgcgggcacacgccaagctggatggcctggcgcgtgagcgaaaagaccccggaaataagggcctgggaggcgatgaccgtggccgccgtggacagcgccgccatggggtagagcagggtgtcgggcacgaggctgtaaaacgggttgggggcgatggaaggatcgagcagcagccccgcgccctggccgaaatagttgagcagcaggcaggggaagaccaccagcagccaggagcgctggatgggccggcggccgaaatggccgaggtcggcatacagggcctcgccgccggtgatgcacaacaccaccgagccgagcaccaccaccccatgtagttggttttccaggaagaacttaacggcatggatcgggttgacggccgagagcacctggggagccagcaggatttccttaagccccagcacggccagcacggcgaaccagacgagcatgaccgggccgaaaaccttgccgatgccggccgtaccccgtcgctggacggcaaagaggccaaacagaatcaggcaggtgatgggcatgaccaggggggcagcggcgtcggtggccacggtcaggccctccacggccgagagcacggaaatggccggggtgatgatgccgtcgccgtagagcagcgccgccccgcacagccccagaaaagccaggaccgtgcgcacgtggcgatggccggcgtccttgggcaaaagttcgatgagggcgaagatgccgccctcgccccggttgtcggcggcggtgatgaaaagcacatacttgaccgtgataaccatggtcagggaccagaagatgagcgagagcacgcccagaatgttgtccggggtcacggcgatggcgtggatgccgtggaaacactccttgatggcgtacaggggactggtgccgatgtcgccgaagacgacgccgagagcggccagggtcagggcggcggtgggcttgggggcgtggccgccgtgggcggcgcgggggctgttcaatcggttctccacggacagggtgctgcggtcaggccggaagacggctgcccgggcgggcaaaccgggccttcatagcgccggggacgacggcgggcaagagggctgggccgccttggggggccactaggcggccgccgccagcgtatccgggatttcttgacgctaacgtgtcggaattgtcattttcccggctggttcacggagcgcccggtctggtcgagatagagcagcgtgccgcccaggatggcgaaggggaagaggaggatgttgaggccagggatgagcagcggcagcccaaagcccagcagcagcaggggattgccggccagtcggcgcagccgcacgccaaagcgctcttcttcccggcaaaacgggtagtcgaggaagtccagggccagaagcatggccgccgcggccggggccagcacctgccccaggaccggaatgaagagcagcagcagcggcgcggccatgacaaagaccgctttcttgatttcctccagcatcagccggccaaaggatagggccggcccctggcgtgacgcgccggccagggccagcatccgcccggcgatgtggtcgtacaacggcgcagccaggatgttggccgtgaccatgaacaggaaatacatgatgacaaaggccaggacgtacaggatgtacttgaaaacatgcaggtacagccaggccagcgcgccggccagtccgccggcctgggcgtcaggggaccacagggcggccagcatctggtcgccgtggctggcgaacacggcaaagcccacgccgtagagcgccaaagccagggcaaagggaatggcgcaaaggcccagatagcctttgtgggccagggcgaagcggatgcctctggcgtgggcggcgagtcctttgggaaaggcggtcagcatggcggtcgcctcctgggagcggctctccaatcagttttcgtcggcgcgctccggttccggggccggccggtccttgggggccagggagccgtggtagccttcggcgtcctcggccagggcggcctggatgcgcgttacctggaagggcatccccagggcgccgaggtcgatgcgggccttggcttccttgacggcatgggcttcgttgtgtccatagacaacgacgtattccatctccgatacgcttttttggcgacgaaaccaacccgatgtaacaagcactttagtggcaaaataaacgcgatacttctgcatgttgcgtataactccggaaaaagggcggcggcaaggacggaatcgaggcagatttgccgaccgtcgaggcggcggacactacgccaagcccggccggtcggcaagtcctgcttcccggcttgaccggggcggccggggctttctacagtcctttgcgcgcacgtcgcgccaaggaggcggcatgaaacgggtgttttggatgctggcgacctgcctgacgatcctgtccggcggccaggccctggccgaagagccggccaaaatcctggtcacggccaaacggctggcctgcgcctatagccagggcatgaacgccgtttttacgcctcaggggcgggtgagcctcaagccgccccttgatcccaacacgccgggactgaccatcgccatcacggaccggaccaagaatcgggctgtgctggaggaggatgccctggagacgccgggcgtgctcatggtctcgccggccggattgtcggtcatggcccgctacgccgacggcggcgtgaccatggtgacggtctatccggtccatgccggcgcttcggacaatctgctcatggtttcctctcgccacggggccggcagtgaaccgcaggtctcccaacgctacggattttgccgccccggccaggaaacacccttgccggccgaaccgcccgcgccgccgccggccaaaaagagcggccactgatgccggtgcgtccaggttcaggctatttcagggccgtggccgccggcctgcttggcctagccctggtgctgacggggggggctgggtcggtccgggccgatttcgacgacgccctgcgcgcgtatgagcgcggggacgacgctcgggccagacaggagttgcggccgctgctttccgcggataatccggccgccttctggctggccggccgcatggccgaggccggccgaggcgggagtccgcccgacatggccgaggcggccaagtggtatcgccgggccgccgacggcggctcggtgccggccatgctgtccctggccgtgctgcatctggagggtcggggcgttccccaaagcgacacccgggccggggagtggctgcgtaaggcggccgggcgcggttcggcccaggctttgctgcttaccggggccatgcgcctggaaggtcgcctggggccggtctcggacgggccgggctatctgcgcaaggccatggccgccggttcgggcgaggcggcggtgcttttgggcgaactctatctggccggcaaggtggtcccccgcgatccggccgaagcctaccgtctagcccttttcgccgaaagcaagggcaagcttggcgagcccttcgccgcccgtctcggccgactgtcggcccaagcggccagcgaactgccgccggcccaggcccaggccatcaggggtcgcggcccgggacgggacgccccgccgcgccaggacgagaaaccggccgaagggtaccgtaccggcacgggcttcgtggtcagccggctgggccatgtggtcaccaacgcccacgtagccgagagctgcaagagccttgtggccatggtggacggcaagcccgtgacggcaagcctgctgcggctggacccggaacacgacctggccttggtgcgattggccgtggccccggacaaggtcctcgtcctgcgcgaaggccgggaactgtcgccggggacgccggtttttgccgcgggctacccgggcgaggcggcgcgcacgggccggatgcgcgtgacctcgggccgcacccgggagctggccagcggcatgggaccggccggggatttggccgtcagcgccgaggtcctgccgggcaacagcggcgggccgctcctggacgccggcggccgggtggccggggtggtgcgggcgcgccgcgacggcgcggcggtgcgggccagggtgggcgaggggctggccgacgtgggctttgccgtgcccctggcctcgctcaaggcctttttgtcccgggggcaggttccttttgtctcggctcccagttccggggaacgcaacgtcatcgatgtggagcgcgatcttgccggagcggtgctgccccttttctgccggcccggccggtagctgcgtctttgcgctttggcccgcacgggccgttctcccgccttctcacgattccaaacggccgcgagcttctcggcttttcccggcacgtcctcgtaaccaccggcgctcatgcggcgacaatgaaaaaggccgggaccttgcggtcccggcctccgcgccggaagaatcgaggagacgaactagaacttgtaggtcagaccgaaagccaccttccaggcatcgccggaacgggacttttcagcaaggcgacgaccccagacgctttcctggaagtcgccgtgagcccagccggtttccatgacggcggccaggttctcgtagatcatgtacttgttgtcgaagttcacggacaacaactgctcgttctgggtcaggtcgcgacccatggtgaagtacgggttggagccgatcaggttgttgaggttacgcagggcagccggggagttggtgccacggacgtagttgaaggtcaggcgatgggtcagcttttcgatgaacgtgatgttgttcagcgtggcgccaatgccccagttgccgaccggagacacgcccatgttgccttccttggccagatcctgcgagttatcgaacaggaagctgttgcccggaccccagttggggcggaccatcggcatacgctcggaaccgttgcgggtggagccgtcttcaccggtggaccaccagccgtacagctgcggggtaaggatgtcccagccggtgtactcgacgccgaggtcaacaaaccagccctgacgcttgctcttcttgcggtcggactgagcgccggcgccgtagatcacgtcagcgtagaacttcacgggatcaagagcggtcacttcgaaagcgccgccagcccaccagaaggcgttctggtcgttcttccacagagcgggggacacgaaggtgccgccggagaccaggttctgggcgaagccagtggtccagtagttggcggcgtcgccggcgacggcgacagcgccccacggggtggccttgaagccatcaagggtgatgggcagggccaggaagtacatgtccagttcgtcggcgacctgagtggtggtggtgtcgtaggtccggttggtgtcgatgagacgaccgaagccggcgagcacgctcagggtcttgtcgatgagcggggcgctcacggtcagcgcggcgatgcggtcgccgccgaagaccggggaggcatagaacatcttggactggggcaggtcgacgtcctggagaccggcggtcacttcgacatcctggcaaccgggcaccttgaactgcaggaaggcctggtagacgtcgatggagacttcggggttggcagcggtgaaggtgcccttgccccaggtgttctcaacgcggatgcccagacggaacttcacggcctcgttggccacgaagtcggagcgcagacgaaaacgttcccagatctggaaacggtcttcggtctgggtgccagcctttttccaggtggtggggctggtggcgctggtccacgaagaggtgttccagccggtgaagttgtggttggcgaaaaagacgccgtagatacgggcgtcaccggtcattttgacttcggtggcggcctgagcggaggcgaaagcccccagcacgaaggcggccacgagagccagggcggcaaaacgcttcataaaatccttcctcctttcgtctctcaaaacatgtccggcgcgtatccgggggaggctaccccccggacatgagaaactattacccgaagccccggtgacaacgcaaggggttggtaaaaaattttttaccgaggtcttgatttgacacaaaagtgacatgctttgaaagatcgtccagaattgtcacacggtccagacgtcgatcagaggaaagcataatagcttgtgaatacagtgtattgaaatcgcaaagccgtgcggaggccggtcgcggaggcggcggtcgccattgaaacggtcggaatgtgtcgaggatgcccttacagcgtcgggtccgcgtcggacactcatcccgggcgcaggcaggcgcgtgcccgccaaggagaggacgggaggcctgagttcggactcccgggaagcgcccgccggccacggtctgtatccgtttcgcgcggcagcgcctggagacgccaaggcaggcttcgggccgtcccgttgccggcaaggcagaccggcaacgggacggccgtatggcggcggccatacaacatgagcaggaggcgcgtcagcgcaagaagaggaacaaaggacgcaaaaaaggcggcgagtcgccccgccgcctttcttcctcgaagagcgaaagctctagacgcagccggtgggcttgggcaggccggccattttgcaggctcctttacccggtccggaggggaacagctcgtagatgtgcttcagcttgaatccggtcaccttggacaggatgcgcaccatcggggcgatgccgttcttcttgtagtagtcctgcaggaactcgatgaccttgttgtgctcgggggtcagctctttgatgccctcggagtccttcacgtagtcaacccattccagggtccagtcttcaaacttctgcaggaagccgtcttcatcgacctcgaaggttttgcctttgtattcaacagtagccatgcgcatcctccttaaacggttgatgatacaagcgcccggccgagattgccttgcagccgggcggccctacgccttcccgcgtggcgggaggcgttacccagaatcagagcacccttgatgcccgatgggtcatgattggaggggaacctgcaccgttggggcgtcaggctcccgcgttacgtttgaaaccgtaatcgcgaaaaacggttcctgtcaacggtttttcatcgaacaggcgacagcttcattttgcttttgtaataaatgacgcttggttgcaatgaattttaaggcttaaggccgttgcaaggccgccagttcgtcgcgggcaaacgtgatggacgggtccagtttcagggctgcttccagatagtgttcggccagggggccgttgcccaggcgggcctgacacagccccaggttggccagatccatggccgaaccggagtcaagctccaaggcggcggcttcgtagcgtgcggccttgaaatgggccaccccgcgcagattgaagtattccttcacctcgggacacaggccgatggcccggtcgaggatgggcacgatgtcctcgaaacggccaagctgggacagggcgtgggcctgatagaaggcggccagtcccttgtcctcggcgctttgctggagattctcggcgcaggcgaactgggcggcggccgcctcggcgtcgcccaggcgcagggacagcacgccctcgaaaaagggcacgaagggggcgctggggtagacctcggccagggcagccagcccggcgtcggccgtggctggatcggcctcctcggccaacagccggccggtgaaaagccccaggctggcggccggagtgcgctcgcggaaccaaaagcccgggatgacgttgtagttggccgaaaggcccagctcgggatgggtggtgtccacggtgaggagcttgtggcccagccggcccagggactgggccagctcggccagttcctcggcgatgtcggcccgctcgatgctcggcaggctctccagcgcaaccagcgggccgtccaggacccaggccgcttcgtccaggctcgtgaacttgggcaggcccgaggcctcgtagttgctgagcgactcgaaatccccggccagctgggccacttcggtcagggcccggatggcggccttggccggcgaggcggccgtgccggcggtgaaaacgatctccgaggcgttgggaaaggtggccggatcgtaggcaatggcggccacggtgggcacgggctggcccagggtgaagtccttgagccagaccttgacgccctggctctcgaaggcggctaggagcttattgaggaccgggtccttgatgtcggccggatcgatggtcggcatgacgcggcgttcgcggtcgatgacggcgcagacatggcgctcgaccagctcgcaggccccctggagcacggattcctcgaagcagttgccggcggaagatccgttaaattcgttgagaatcttgaaccagtccaggggcacggccacatccttgccggcggccacgtcacgcactttgatgaagcgccaggggaccaggtcgaggatgcgccgggcgtcggcctcgctcaggttctcgcctacggactggaggatgacggacagcggaatgagcgcgtcaccgtactcggcttcggcctcggtccaggtggccggcaggaagcgggcctcgtcgcgccagaaggagaagaaactgtaccgttcggccagttccatcagggccgaggcctcggcctgctcggggctggcccctttgcccatctgtttgcgggtgggcatgacgctgcgggcttcgtcgccgcagatgctcaaaaagaccggaatgccgaggcgcccggtgtcgatgcgcctggtctcggccaacacgccctggcccaggcgggcaaaggcggccctggcccgggcgatggtttccacggggctgatgattttatcctggtcgagggtgtagcccttgggacgatgggacaggccggcggcctcgatggtgtcgtgggtcatggcgtttccgatgcgaaaagcggattgggtctcgtgtcgcgtccacgaaaggcacaacgggcatttcgtagagaacagcctaaaaccatggagttgtcttaaaaattatacgcgtattgttaagggacgcggctctaggcgacctttttcggggtcaggcggtagagctggcagagcttgcgctcgggctggccggactcggggttggtttccttgaagcccaccacgcgctcggcgatggcgaactcctcgtcggccatggccaggaaacgggtggcctttcgggtgtagtccttggccaggagcacggcggcgtcttttttgagggcgatatgggccagcaggaacttcatcagtccacggtaagcgtcctgcatgtagagcacctcggccccgaggatggcgtcgaagcgccggcccagtcggtcggccgtgaagtcggcccgggcgaccttggcccggtgggccaggccgttatgcaggatgtttatttgcgtaaaaagcagcgcgtcggggtggatgtcggtgagcagggtgtcatagccggcggcggcggcgaaaagtccggccacgccgatgccgcagccgacttccagggccgagcgaccggccggatcgcccaggccgggcaggccgtgggccagcagcacggccccgggccatacggcggcccagtagggcagctccaccgggccgtcgccggcggcggcgagctggcggtcaatgagcgcggccacgtcggcgatttgcaggagctccaggcgggtgtcgcccacggccacgggttcaaagcagacgtcgtagcggcagcgagccgcgtcgagcagttcgtcgaggggggcgtcaagagcgatggctgtgtccacaaatactcccattgcggtatgaatttccggcaatagcccaagagcagggacaaggcaaagaaaaagggccggctttgcgggccggcccttgcgattttcatttggagcgggaaacgggatttgaacccgcgacttcaaccttggcaaggttgcactctaccactgagttattcccgctcaaagatcagcttgtggaggcggcatccggatttgaaccggagaatggaggttttgcagacctctgccttaccacttggctatgccgcctcgtttcaaggagtccgagtatttactcgctgccggcccggttgtcaacgactttgttcaactttttttccgtccggtccggctcggcggggcggccgccgttgccgaggcgcataactgtcaaaatccggcccgctcgtcaacaggaaattttcaatttttcaatttttgaccataaaacactgatattaattgcatattttttccatccaaaagccgttttcggggccgcttcggcccgcattcggggcggatgttgcggggtgtcccgtcatgggccgggatttcctgggtttttcttgggcctgaccggcccgggcgggacctcatcgacccggcaccgccagtgccggcagcccggattgcccttggccggccagcagcttcccacgctccgagggcggcgaatcttcttgtcggccaagctccgggccggcccacccccataaaaagccgccgaggcggacctcggcggcttgggggattggggaggggaacgcttgcgaggggtcagctttgctgaatgggaatggagcgggcggcggcctcggcgtcgcggggcagggtcacggtgagcacgcccttgtcgaagttcgccttggcctcggcctccttcaccttgcccggcagcgggatgacgcgggagaaggagccgtaggcgcgctcaatgcggtggtagtcgtccttcttctcctcgccctcgaacttcttttcgccccgcaggatcaagacgtcgttctccacggtcagggtcacatccttgggatcaagccccgggagttcggccttgaccgtgaccactccctcggcttcgctgacgtccacggccgggtaggccatgtccctgaacagcggccccagggcggttgcgggttcgcgccagaagtcttccatgagatcggccaggctcgcgggccggcgcacggccacggagcgctcgcgaagacgcggcaacaaatgcttgaacatagcccatacctccttggagaaatggattatgtaaactttataagcacgccgtccggccagtcaaggcacggacggcgtgtcggggtagggtcaggacttgatggatttgccggtcaacagctccaaaagccgccagctctccttggtgaagtcgccctcggtgtcgcttaaaaagaccacggccgagcggtcagccggcgacatgaggaccagggcgaaatagccgcccgagcggccggcgtggagcacgtaggccttgccggcgaaattcatgacgttccagaaatagccgatgtacagcgccgggatgtccgagacgtgtttgcgcggcagatgggcgaaaagcgcggccggcaggatgggcgtctggaccaggcccaggttggcggccgcgtaggcgagcaggtcgtcggcggtggagcgcagggcgccggccccttccaggcccgtgacctcccagttgggcacgaccttgcccttgtcgttgtggccgtgggccaggcgggcacgctggtcctcggacagggtcacccgggtgtcggccatgcccaacgggtcgcagatgcgctcgaccacgagcttttcatagtccatcccggcggtccgggccaggatgtagccgctaagggccgcgcccatattgctgtaatagaagttctgccccaccggcgcgatgggcttggcggtttccagggcgcgcaggagcaggcccgtggaatagccggccaggggattggcggggtccttggacggcaggttgtccggggccacgggcaggcccgaggtgtgggtggccagatcgaggtggctgacccagtacagcggcgagtccttgccgatggttccctcgggcagcatgaggcggatggggtcggtgtcgcgcagcttgccggcgatgacctcctgggccagcaggatgccggtgaagctcttggtgatggagccgatctcaaagagcgttcggccgtccggggccttggagcgcgaggattcatcgcgccggccgaaaccgtagacggctttcccggccgggctgacgtagccgaccaccaggccgtggacgcgaccggagcgggtcagcccctcgaccacatgggccgtggtctggcggccgggcaggggggcggcacaggctgggcgcggggcggcggctccaagggcggccaggacgaaaagcatggcgacgcaacggaaaaacggcatgggaacgctccggttcaggcgtggttgcgcagtttgagttcaatggggtgaggggccaagtaggcctggtcctttaaataggccacgtcgtatttgcgggtgaagtgggcgatgagcgttacgggaacgatgagcggggtaagccccaggcggtagttggcgatgacttcgttgagttccgctttctcgtaggtggtcaacacttttttgaaatagcccatggcgtgctggagcacgttggcgtgcttggccggggtggccggcagggccagggttttcatgagcagggtctcgtaggcatggacgaggccgtcggccggccatttgctggcttcggccgtgagccggccgatttgccgggccagctccgggctgtgggccatgaacagcagcttgtgcccggcggtgaaggcgatgagtcgcgaaaccagggtcgagcggccgtcgccggccacggcgtcgcggaagcgctgcatggcaaatatgcgttcgatgaagttttcccgcagcttgtcgtcgtggagcctcccttcgtcctctaccgggatcagcggaaagcggtccatgaaggcccgggcgaaaagaccgaccccgcgttcggccggagcacccttatcattatagaccttgatccgggtcatgccgctggagggcgacttggccttgaagatgaaaccgcacagtcgctcctcggccagttcggccacgcgccccgctgcccaggcgttcatgcgctcggtgagatcgacgccggtcttgatggtgaccaggcgcggggcctcggggtcgccgaccaaccgcatggcttcgcgcggcacgcccaggccgcattcgacctccgggcacacgggcacgaattcaaaatagcggcccagggtatcgacgacgtagctgtcgcgtttgtggccgccgtcgtagcggacgggattgccgagcaggcaggagctgaccccgacacgtatggaatccgacattttttcctccaaccccaatacgtccgccagcccagtcccccctttttcttcgaatggggggtccgggggcctcaggcccccggccgccggaggcatcttccctcttcgcaattcccgacttgcttgggacgctctttacggctacagccttgcgggcgttttccgtatatacggccttcgggccggcatgggaagcgacgccgcgagaaatgggggaaccatgagccaggtatgtggacttcgggccgtgtttttcgatttcggcggcgtgttggccgaggagggctttcgccaggcgctcatcgacatcgcccgggaggccggtcgcgatccggccgaggtggtgccggcggcctatgagatggcctggaccacgcggttcgtggtcggcggctgcgacgaggccgggttttggcaggcctttcgcaaggccacgggcattgcggccgacgacgcgcatctgaccgaggtggtgctgtcgcggttcgtgccccggccctacatgttcgccctggccgacgcggtgcgcggcctgggccttaagaccgcgatcttaagcgaccagaccgagtggctggcccggcttgacgcccggcatgacgtcttttcccatttcgatcaggtctttaacagctaccatcacggcacgtccaagcgcgaggcggcgtttttcgagctggccctggcggccatggacgtgacggccggggagtctcttttcatcgacgacgcggcccacaatacggaactggccgcccgactgggctttaaaacccttttataccgggaccgggagtcgtttttcgccgaactggccgacctgtgcccgccccttggagcgctttaaatgtataagcccatttgcggcctggcccgcgacggactgcccatcatcggcgttttcgccctggcgaccctggttttcgccctgctgcgctggccttgcctagccaccatcagcctgttgtccacgattttttccttcaatttcttccgcgacccggaccgcacctcgcccacggaaaacggcatagccgtgtccccggccgacggcgtggtctgcaagctcggcgaggcggcggacccgatcacgggcgagatgcgccaggtcgtgtgcgtgttcatgaacgtttttaacgtccacgtgaaccgctcgccggtcacgggcgtggtttcggaagtgcgctacattcccggcaaattcttcaacgcttccctggacaaggcttccacggacaacgagcgcaacgtcattgtcgtcaccgatgccgagggcgcgcggtttaccgtggtgcagatcgcggggctgattgcccggcgcatcgtctgcccggccaaggccggcgatacgctttcgcgcggcgaacggtacggcatgatcaagttcgggtcgcgccttgacgtctatctgccccatggctatcatccggctgtcgccatgggccagaaaaccatggccggtgtcaccgttttggcgaaaaaggccgactaaccgggcttgccccgttgacgatcacgtagcgagatggaagaaaaagtcacccagagccgggctcgcaggagcgtgtatatcctgccgaacctgttcaccatggcaagcctgttcgcgggctttctgggggtgctttgggctatcgaagggcagtttgacatgacggccctggccattctcttctcctgccttttcgatggccttgacggcaaggtggcccggctcaccggcaccagcagcgattttggcgtgcagttcgactccctggccgatctcgtggccttcggcgtggccccggccatcatggtctaccagtggcagctggcccgcttcggccgcctggggattctggccgccttcatgctcgtggcctgcggcgcgctgcggctcgcccggttcaacgtcatgtccggcaagaccaccacctccaagaagttcttcgtgggcctgcccatcccggccgctggctgcatgatcgcgctgtttttcatgttcgagcgctatctgcccgacgacatcgccgccgctgtcatccccaaggcctgcctcgtgctcgtgtacgccttgtccttcctcatggtcagccgcgtgcgctacgcgtcgtttaaggaactcgggctggtcaaggcccatcccttcagcgccatggtcacggcgctgctgcttttcgtcgtggtcgcctccgagccctggctcatgggcttcctgctcttttccgcctacctcatctccggcatcttctacaccttcttcattctgccgcgccgcaccaagctacgggagcccctccaggagctctcataacaccgttatcccctttttgacatttcttgtcacttgccccggcccaggccaaccagagtgcctcggcgcgtgctcacgcgcgcctgatcctctccgcataagcggagaaaggggagaccctcatgtccgacgacaacagggtatacatctttgataccacgctccgtgacggcgaacagtcgcccggagccaccatgacccgcgaagaaaaagtccgcatggcccgccaactcgaaacccttggcgtggacatcatcgaggccggtttcccggccgccagcgaaggcgatttccaggccgtctcggccatcgccgccgccgtcaagaccccggtggtggccgccctgtgccgggccctggcctcggacatcgaccggggctttgaagccatcaagggcgcgcagcgccgccgcatccacaccttcctggccacctccgagctgcacatgcagcacaagttgaacaagaccccgacccaggttctcgacatgatcgaggcggccgtttcccacgccgcgtccaagggcgtcgaggtccagttctcggccgaggacgcctcacgctccgaacctgccttcctcgttgccgcctgcgagcgggccataaacgccggcgcgaccatcctcaacatccccgacaccgtgggctacgcccagccggccgagttcgccgagcttatccgccacctcatgaccaccgtgcgcggagccggcggcgtcaccttcgccgtccactgccacaacgacctgggcctggccgtggccaacaccctggccgccctccacgccggcgcgcgccaggccgaagtgacgctctccggcatcggcgaacgggccggcaacgcctccctggagcaggtcgtcatgggcctcaacacccggcccaactactataacctgaccaccggcatcgtcaccgaggagcttttcccctcctgccgccgcctgtcgggcatcatcggccagccgattccgccctatgcccccatcatgggtcgcaacgcctttgcccacgagtccggcatccaccagcacggcgtgctcaaggatcgccgcacctacgagatcatgactgccgagagcatcggccgcaaaggcgctgtggtggtgcttggcaaacactccggccgccatgctctggacgccaaggtcaaggaactcggctatgctttaaacgacgaagagctgctcgtggtcttcgtggccgtcaaacagctggctgaccgcaagcagcgcatcctggacgaagacatcgaggcccttatcctcgaaaaagtcctgcgccgcccggaccgctacgccttgcagttcctgtccgtacactgcggcaacgtggaactcgcgccctttgccgtggtcgaaatgcaggtggaaggccagaccgtgcgccactacagcgccggttccggcccggtggacgcggtctttaacgccgtctgccaggccgtgggccgcaagcccgacctcgaagaataccagatcaacgccatcaccggcggcaccgacgcccagggcgaagtgaccgtgcgcatcaaggacggaaccgcgaccactgtcggccgcggcgtccacgacgacgtcatcatggccagtaccctggcttttatcaacgcgctcaaccgtttggccaagaaggaggaggaacggacatgcccgcaactttagccgagaaaatcctgcagcagcactgcgatgagcagattacaggtcccgggcagatcgtccgttgccggctttccctggtcctggccaacgacatcaccgcgcccctggcgattaagtcctttaaaaagatgggcgcggccggcgttttcgacaaagacaaggtcaccatcgtcgccgaccacttcacgcccaacaaggacatcgaatcggccgaacaggtgaaggtctgtcgcgaattcgccaaggaaatgggcatcacccattacttcgaaggcggcaacgtcggcgtcgagcacgcgcttttgcccgaactcggcctggtcggcccgggtgacgtggtcatcggcgcggactcccatacctgcacctacggcggtctgggagccttcgccaccggcatgggctccaccgacgtggccgccggcatggccctgggcgaaacctggttcaaagtgccgcccaccatccaggtcatcctcaccggcacgctgcgccagtgggtcggggccaaggacctcatgctggcgctcatcggcaccatcggcgtttccggcgcgctgtataaggccctggagtttgtcggcccgctggcttcggccctgtccgtcgaaggccgcatgaccatgtccaacatggccatcgaagccggcggcaaggtcggactcttcgccgccgacgacaagaccctggcctacgccgccgcccacggccgcaaaggcgacaaggccattgccgccgatgccggcgcggcctacgaacgcgtcgtcaccatcgacgccaccggcatggagccgcagatcgcctgcccgcacctgcccgacaacgtcaagcccgtctccgccgtggccggcctcaaagtcgatcaggccgtcatcggttcctgcaccaacggccgcatcgaggacctgcgcgaagccgccgccatcctcaagggccgcaaggtgagcaaggacgtgcgcaccatcatcctgcccgccacccccaacatctggcgccaagccctggccgaaggcctcatcgagaccttcatggacgccggctgcatcgtcggccccgctacctgcgggccgtgcctgggcggccacatgggcatcctggccggcggcgaacgcgccatcgccaccaccaaccgcaacttcaaaggccgcatgggcagcctggaaagcgaagtctacctctccggccccgccgccgccgccgccgccgctgttgccggcgagatcattgatccggccaaggtgtagtagagagaggaagaataagatgcctccggcggccggggacctgaggcccccggaccccccaataaggggagggtcgctcgcgaggcttagagcataaggagagagacatgtaccacggtactgcccatacggtcggcgcgcatatcgacaccgacgccatcattccggcccggttcctggtcaccaccgacccggccgaactcggggccaactgcatggaaggcctggaagccggctggatcaagaaagtgaagcagggcgacatcatggttgccggcgaaaacttcggttgcggctcgtcgcgcgaacacgcgcccatagccctgctcggagccggcatcccggtggtcatcgcccacagcttcgcccgaatcttctaccgcaacggcttcaacatggggctggtgctgctggagatcggcgacgacgtgagcaaaatccacgacggcgacgaactcaaggtcgatgccgataccggcgtcatcagtaacgtcaccaccggccagaccatccagtgcaaacccgtgccgccgttcatgaaaggcattctcgacaaagggggcctcatcccctacgtccaggaccgcttggcggagcgagtgtaggtaagaaggaagagaagagtgcctccggcggctgggggcctgaggcccccagaccccccaaatgggtgaagggggaccggctggccgagtgcactctcgcataaataatttgccttccattcagggggtccggggggattatccccccggccgccggaggcatcttcaataatattttcgaggttagcacatgcgttacaatatctgcgtcatgccgggcgacggcattgggccggagatcgtggccgaggcggtgaaggttctggacgtggtcggcaagaagttcggcctggagttcgcctacacccaggcgcttatcggcggcgcggccatcgacgccgtgggtgtgccgctgcctgatgagacggtcgcggcctgcaaggcggctgacgccgtgctgctcggcgcggttggcggccccaagtgggacgagatcgacccggccatccgcccggaaaagggcctgcttggcatccgcaaggcgttgggactgttcgccaacctgcgtccggccaagctgttcccggagctggccgccgcctgctgtctgcgcccggacatcgtgggccagggcctggacgtcatggtcatccgcgagctgaccggcggcgcgtatttcggcgaaccgcgcggcattgagaagcgcggcgacgaggaagtcgggttcaacaccatggtctatgccgagcacgaagtgcgccgcatcgccaaggtgggcttcgagaccgcccgcaagcgcggcaagaagctgtgctccgtggacaaggccaacgtgctggacgtctcgcgcctgtggcgcaaggtggtcctggaagtggccaaggactacccggacgtggagttgagccacatgtacgtggacaacgcggccatgcagctcgtgcgcgctccgtcgcagttcgacgtcatcgtgacggaaaaccttttcggcgacatcctgtccgacgaagcggcggtcatcaccggttccatcggcatgttgccctcggcttcccttggcgcggccaacccgggcctgtacgagcccatccacggctcggccccggacatcgccggccaggacaaggccaaccccctggccaccatcctgtccgtggccatgatgctcaagcattcctttgaccagcccgccgccgccgaggccatcgaagccgcctgcgccaaggtgctggccgacggctaccgcaccggcgacatcatggagccgggcaagaccctggtcggctgcaaagccatggggcagttggtggtcgagcgtttgggatagtcattctcgtttgttttcagctcattaaagcgtcacgggcaggagaccccctcggggctggttctcctgcccgtttttgcgtacaacgcgcgcgaagccgatgaaggttctgacggaaccctcttgccacgctatcggggattccaaagggcgagagccctttggccgccggaggcttcctcctgatcctatggccggctccacgaaataacttccagccaaacgacgcactccccatggccaaagtcagtctgcaaaatatttccaaggcctatgccggccgcgacctgtttagggaattctccctggagatccccggcggtacgcgcctggccgtggtcggccagaacggcgcgggcaagtccacgcttcttaaactcattgccggcgtgtccgaacccgacagcggccggatggtcctctccaccggcgcgcgcctgggctatgtggcccaggaaatggacgcttccgatctcggcatgtcgcttttagcctgggtcatggccgcgctgccgtcctggaaggaattctggcaacgctacgacgcggccgtggccgccggcgacgaggcggccatgacggccctggcccacgagcaggccagcctcgaacatgccctgggctacaatcccgagcatcgggccaagaccatcctttcgggcctggggtttgaggaaaagcatatggccggccccttgtccggcctgtccggcggctggcgcgagcgggccaagctcgcccgggtgctcacggccggggccgacgtgctgcttctggacgaacccaccaaccatctcgacctcgaagccgtggcctggttggaggcgtttttgaccgccttcgagggcgtgctcatcttcgtggcccacgaccgggtgtttctcgaccgcgtggctacccacacgctgtttttgggcgaaaccaagcccatctggcggcccgggtcgttctcccagtttttggcctggcgcgaggagatggaaaagcagtgggagcggcaggctgcggccatcgacaacaagatcaagcagcacaacgtctttatcgaccgcttccgctacaagtcgagcaaggcccggcaggcccagagcaagctcaaaaacgtggaaaagctcaacaaggagatcgagagcctgcgcggcgaccggcccgacgtgcgcggccgcaccctcgatttctccctgcccgagcccgagcgctgcgacaagaccgtgtgcgccgccgccgatctggcctaccactggcccgaccgcgcgccgctgtggccgccgctcacctttcagctgttccggggccagaaggtggcgctcgtcggccacaacggcgcgggcaagaccacgcttctaaagctcatcgtcggcgtcaacaaacccaacgacggccggctggtcctcggcacgggcgtcaagctggggtatttcagccagcaccagacggagatcctcaataccgaaggcacggtcatgtccgagatgcggcgcatggccggccccaaggccacgcatctggagtgctgctccaccctggggctgttccttctgggcgaggactattgggaccgccgggtgttcgagctctccggcggcgagaagtcgcggctggtgttggcgggtctcttttcggcgcgggccaatttcctggtcctggacgaacccaccaaccacctggacctggaaagccgcgaagcgctggtgcgcgccctggccgaatattcgggcaccatcctgatggtcgcccacgaccgttatctcttgcgcgaggccgccgccgaggtctggtccgtgggggctgaggggctggtcgtttacgaggaaggctacgccgcctacgaggcggcccggctggccgaggccgccgccgcgtccaaggccgagggggcgggcgcggccgaggacaacgcccaaagcgcgcccaagctgtcgcgccaggaggacaaggagcgcaagcgccgggtggccgagctgcgaaacgccctctaccgcgacatcaaacccaagcgcgaggcctttgagaagctcgaagccgagctggaaaccttgctggccaagcagtccgaagtcgaggccgtcatggccgatcccgaaacctacgcccagcgcgaactgttttccaagctcagcaaggagtacagcgacctttcgcgcgaagccgaggatctgctcgcccgcatggccgtcatggaagaggagatcgccgatctggaggcccgccgggccgccctggtggaggatgtatgagcggggccgccaaagttgtcgaggtggtggccgccgtcatctggaaggacggccggtatctcggcgtcaagcgccccgagggcaaggccatggccggagcctatgaatttccaggcggtaagatcgaaccgggcgagacgccggagaaggcgctggaccgcgaactttgtgaagaattgggcataaggcctgtcacgattgcctttttccgcgaaaaagcgcatgcctaccaacacctctcggttcgtctccatttttttcacgtccgggcgtatgacggggagccgctccccttggaaggccaggacatggaatggctgacgcccgaacagggcaggaccagaccgtttctggaggccgaccgcgacatcgtggacgccctagtggccgaaacggcttgacccgccggcttatttgccggcaatgccaaccccccttgaagagtttttggggaaagggggcccgggggaaaacccctttgtgcaaaaaggggttttcccccggttcttccttcccctccccaaaggagacgctgtgcggatcagggagttgatggaggccaggcggccgtttgtttcgttggagtttttcccgcccaaggagcgtgaggcctgggacgggtttttcggcgtggtcgagaagctcatcccggtgcgcccgcttttcgtctccgtcacctacggggccggcggcagcacccatgcccacacgctggagatcgtctcgcgcctgaagaccgcctacggcctggagcccatggcccatctgacgtgcgtgggcgcgagcaaggacaagattcgcggtttcctcggcgccctggcccaggccggcgtggacaacgtcctggcccttcgcggcgatccgcccaaggggcaggagacgttcgtgccggattccgaggatttccagcacgcttccgatctcgtggccttcatccgggccgagtatccgaacctgtgcctgggcgtggccggctatcccgagtgtcatcccgaggccgtctcgccgcaagaagatctggagcatctgcgccataagctggccctgggcggcagctttgccgtcacccagctctttttcgacaacgaccgctatttcgatttcgtggcccgggcccgggccgccggcattgacgcgcccatggtgccgggcgtgttgccggtcctcagcctggccagcatcaagcggtttgccgccctgtgcggcgcgtcgctgccgccggcctacatggccgagctggaagcggccgatgccgccggcggcaacgccgccgtggccgaggttggcatcgcttacgcccgcaagcaggcccaggatctgctgcgccggggcgcgccgggcgtgcatctctacacgctcaacaaggccgaggccgtgctctccatcgtctcgggcctggaatattagtcgggacaccgtcgggggcagagagaagaaccatattgaagccgttcccgttgcgggtttccaaagggcggcagccctttggccgccggaggcttctccccctgaacatctcgcaacgcattgacgacaattttcgccgcgcttcctgtcgggatgcgctcggttgcggagtgcggcacacacgcagattgccttacggaggatcgtatgggcgggggcgagttggttgtggcagtggccggcgccacgggcgccgttggccgtgaaatgctcaagacgctggaaggtcgcgctttcccggcaacgaccgtgaaagccttggcgtcctcgcgctcggccggcactaccgtgccgtttgccggcggggagctcatcgtcgaggaaatgaccgagaaatcctttgaaggcgtcgacatcgcgctgttttccgccggcggctccacctcgaaacagttcgctccgttcgcggtcaagtccggttgcgtggtcatcgacaattccagcgcctggcgcatggaccccgaggtgccgctggtggtgcccgaggtcaatcccgaggacgtggactggcacaagggcatcatcgccaatcccaactgttcgaccatccagatggtggtggcgctcaagcccctgcacgacgtggggaaaatcaagcgcgtcattgtttccacctatcaggccgtgtccggcactggccagaaggccattgccgagctggaaacgcaggtgcgccagctgttcaacagccaggaaccggacgtgaaggtgtatccgcaccagatcgcgtttaactgtctgccccagatcgacgtcttctccgatggtgactacaccttcgaagagatcaagatgatcaaagagaccaacaagatcatgggtgacgactccatcaaggtgacggccaccactgtgcgcgtgccggttttctacggccacagcgagtcggtcaacatcgagacggaaaaaaagatcacggccaaggaagcccgggccatcctgtcccaggctccgggcgtcgtggtctacgacaacccggccgagaagatctatcccatgccgctgatggccggcggcgaagacccggtcttcgtcggacgcatccgcgaggacaacaccatcgaaaacggcctgcacctgtggatcgtggccgataacatccgcaagggcgcggcgctcaacgccgtgcagatcgctgaactgctcatggaacgcggccaggtgcgcgtttaggcggggagagggaagagaagatgcctccggcggccaggagaggctctgcctctcctggacctctccgccgggggcctgaggcccccggaccccccaattgggtagaaggggagcgttggtgcggaccatggaaaatggcgccgcgacaacgcgcgaatggtgcttgctaaggcctcggaagcggggcaaacgggggaaacggccgagcgtcgtttcccccattttgcatagaaggagtgtcccatgcctgagattgctgacgcccaaacgtatttggaacgcctgctggccgcgccgcgccccgggggcgagggcgtgctggcgttttacgaccaccgtatcggcgtcatcggcaaggacccgcgactcatgctcatgccgctggacgaccatctcgtccaccggggcgacggcgtcttcgagaccctcaaatacattggtcgcaaactgtatcaggtgaagccgcatttcgaccgcatggcccgctcggcggcggcgatccatcttgatccgccgtgttcctgggacaaggtcgccaagctgacccttgacgtctgccgggccggcggcgtcgacgacggcatggtgcgggtgctggtcggacgcggccccggcggctttggcatcgacccggccgaatgcccgaccccgagcctgaccatcgtggcctaccgcttccacccccggccggccgtgtcctttgctcagggcgtcaccgcctttcgcacctccatcccggccaagcagaactacctggcccgcatcaaatccatcgattacctgcccaatgtgctcatgaagcgcgaggcgaccgcgcgcggcgaagattatccggtctgctacgacgacaagggctttctggccgaaggggccacggaaaacatctgcatcgtggacgccgccggccgcttcgtggtgccggaactcaccaacgcgctgacaggcaccaccttgcttcgggccgttgagcttatggagggcgagatggaagtggtctttaccggcatccgcgaggaagacatcgccacggcccgggaaatgttcatcctcggcaccaccaacgattgcctgagcatcgtgcgctacaacggcgtccccgtcggcgacggccggcccgggccggtgtcgaaagccctcaaggaacgcctggttgccgacatcgcggcgaacgggacggcattttagggtaagcgagaagaccttctgttttaacgacatacggtgtaattacccacaatgtgcgggtattcgttactgcgttgccgccatggttcgactgggaggacaaagggatgaaaattgaatccataaggctgcgcaatttcaaatccttccaggacgccgaactctcggacctgccaagcttctgcgtcattgtcggcgccaacggcacgggaaaatcgaccatctttcaggtgtttggttttttgcgtgatgccatggcgagcaacgtcaatgtcgctttggccaagttgggcggcagccggggatttcaggaagtccgcagccgaaacgcccagggtcccatagagattgaattgaagtttcgggctggcacagagagtccgctgacgacctatttcctgcaaattggcgaacacaacggcaaggccatcgttgaacgggaaattctcaaatatcgccggggcagtagcggtcaaccctggcattttctggatttctcacgtggccaggggacagcggtcaccaatgaactggagaaaaccaacgatgttcgggaattggacagggaagagcagaaactgaaatcagctgacatcctggccataaaggggctggcgcaatttgaacgttttccggctgtgatggcgctgggcaatctcatagagaactggcacatctcggattttcatataagcaaggcccggccggaacaagaggccggctatgccgagcacctctcccgggagggcgagaatctatcgcttgtcatagaatacttgtacaagaataagcgaacggccttcgacaagatcttgtcgctgctgcaaatgcgcgtccccggcattacaagcgtcgagtcgaagacaacggaagaaggccgagtcttgttgaagtttcaggatggggcgttcgaggatccctttttagcccgttatgtttccgacggcaccatcaaaatgctcgcctatctgacgctgctctatgacccggccccacatcccctcctgtgtgtcgaggagccggaaaatcaactgtatccgaaactgctgtgggaactcgccgaggagttcagggcctacgcgcaccggggcggccaggtttttgtttcgacgcattctccggattttctcaacgccgccaaattggacgaggttttttggctcatcaagaccaagggctatacccagattcgccgggccagggatgaccaacaattggccgcatacatggccgagggcgaccagatgggctatctttgggagcagggtttttttgaaggggcggaccctcaatgaaaacactggtcttttttctggaagagccatcggccaaggccatgctggagggcatattgcctcggattctgccacggcagtggcttgtcagatatatcgtttttcaaggaaagcaggatttagagaagaacttgactaagaagatacgccattggcgaatgccgaattccgtgttcatcgtgatgcgagatcaagatgccggcgactgtcgtgctattaaatcaaggctcaatcttctgtgcgagggagccaaagacaagcgcatactcgttcgtattgcttgcagggagttggaaagcttctatttgggtgatctcgcagccgttgagcaaggactcaacctttcgggattacgaggcttgcaacaaaagaaaaaataccgaaatcccgacagtctggggtctccgtcaaaagaactttccatgctgacgggctatgcctacgaaaaattgtctggttcgcgggcgatagccccttttatggcccttgatcataattgttcgaaaagttttcaggccctgctcaccggcattcaaaaaatggtggcggcgtagcgcaagacccgggcgtgggggccgatatacgtcgtggagcgacatgatgcgccggcctggaaacaggccggcgcgttctttttcatgggatcagcgccaagatgctggccgtccggctgcgggcaaggattatcggggcaagaccttgtctcccggaaccgttcgcttcgccaggtgggcggccagggcctcggctacctggcggcggccggccaggttgagatgctcgcaggcgtagtcgcggtccacgaactggtcctcgggcagcagcgccgacaggtccaggcagtccacgccggcctcggccaacgtcctgacaacgcgccgggcgctgtccgagaccgtggccgcgaactccccgcccacaagcgacatgccgccttccacgtcgatgggcgtcaggtaaaaaagcgtcgtcacaccggcccgggacagcctggccgccgtgtccagcaggtggccgatcatgggatggctggccgggatgtcggtcatgtagtgcttgatgaaaagctgccggcgtttggcctcttccggggagaggccgggcttcgtcgcggccatgagccggttgcgccgggcgttgatttcccgaaagagcgtttcgtgcccggaggcgtcccgacgcgtgcgcgccgtccaccagacggccgggtcgcgctcgccggacaccagccaggccggcacgtcggccagggtcggcggcgaagccagaagccgcagataatcgacggtggcggcgtacatccagcgcggtgtgaaaaaccagtcatcggaaaacgcgcgcaggttgatggaaacaatagccagccgcggccgttgttgcgccttggcaatgagctcggcgtattcccgaaaaagggtcgccgcgtagcccgggccgctgacggggtggatggacaggccgcgcaggtcgccaagcatcgtggcgatggtggtgcgcggttcgtcgtcgttgtgaccgcccatgactgagtcattgaaatagaccgccgcgacatcgcccttgtggagggcatcccgaaaagccagggctacggcgttatggtaggcgtcggtgcgttgctgttccggcgcgctgtctggaggcgttgttgcgccgatggtcaccagacttttgtagcctgtggacaggctgcgatggccatgcccgaggagcaaggcaacaaggaaaattgttgcggcgacaaggacgcagagaaaacaaggagtgctatgctggcgttgcatgaaaacaggttctcggcttccgcttgaccgggctattgctgccactacgccgtttcaacctggcatggtttgctgcggcgggggaacctttccggcgtggaaagcatccatgccacaccattgggccaatgtccaatgggggacgaagcccgatttgagggtgggctggaaacggcgcccggtcctgatgcaggcgcaaggcggcttatcccgggacaagccgggcgcgggggatggggccgacatgaccggccgggctcaggcaagcggtgcgcgccgtggcaggctaacgcttcggtccttctcaaagaggttagttttttttcagataaataagggcgttggcttgttgttcatgaaacgccatgagcgcttttcggggacgcgctattaacgccgctgcatggcgtcaagcagccagttcgctcctggggcggcgttgtcgcgggaaaaggtccagcgctcgcgcagagtggtgttttccgtggcgccgggctggcgggccagcacgtcgtagtccaccaccatgacggtgcgtccaggcgtttcccggcgttcggccaaggcggcgtttatcagcaggatgtcggggcggccggccggcgtctggggcagggtgttttggagttctgccagataggccgggctgacaaatgaggccagatcgccgaagtcgcggccgcccagggaggcggcgatgcggctgtaggccattttggctccggccaggaattcctcgtccgagccggccggcgcgttggccggggcgggcggcgcggcctggccatcggcccgggccggcgtgcccgggcgtttgtccggcgagcgcagcatgtcccaggtggcctgggcattggtgtacatgtcgggtccgcgccggggcggctgattttgcggcggggcgtcgtcgtcgcggtcgtcctggtcatcggagcgaggcggggcttgggtctggtcgccgtttttgttgcgacgccctgacaagaccctgaagagcacgaacatggccaggccgagcaggatgagattgatgagcagattgccggaatcgaggctggcatcggcggcggcctgggccgtggccgggacaaggacggcggccgaggcggccaggcccagggcggccttggcgggcggcatgacgtgatttttcatggtcagatagtggcaaaggccgtggcccaagtcaatgcgtgcagcgacgacacgtcgcggctgcgccgagccaaccaaacagcatggctcgcacccccttgccccctttcagggaggttccgggagggggttaccccctcccggccgccggaggcatttcttccggtccgctcacttaatcatcccgggccatggtgacagtcggtttggggctgccggggccggcggggcgggggtattcgcggttgtagagcttgcggtagagcttgcgcccttcctcgaagccggggctgagttccagggctttttccacgctcaccttggccgactccacgttgcccatgaagtagtaggccttggaaatgttgaaatggatgttctcgtcttcgggcgtgagcgtcagggcctgggtgtaggcatggagcgctccggccaggtcgccgcttttgcgcagcttgacccccagggaattgaaggggttgggcgagaggggatcgtatttgaggatctcgatgaacagttccttggtctcttccaggcggttgaactgggcatggacctcggcggctttttgcaggtagcgcttgaattcgtcgagttcgcccttggccttgtaggcgtcggccagccccttgtaggcttcggcgaagaggtcgtttattttgatggcctttttaaaggcgatgatggcttggccgaatttctggcgcaccaagcagcggcagcccatgtcgtagtatttctgggcctggctttgttcggagatgatttcctcgaaagcctcgatggcgtcgtcgaagttgccggcggccatcatgtcgcgggcgtcggcgatctgctgtcgctcgatttccgtgacccgttccacctggcagccgcgcaggacgtgcttggcgaaggtgtcttcggagtaggggcgcaggatgtaaccggcgcagccctgggcaatggcgtcaaggacttggtcgcggctggtgttggccgtgaccatgaccaccggcacatcgcgcaggcgcaggtcgcggcgggcggcgcgcaaaaactgcatggcgtccatgtcctcgatgtggctgtcgacgagcaccatgtcggcatggttggcggacagaaaggccagggctttttggcccgaagcgaagacctccacccgctggggccgaaaggaggccagggagcgccggtcacgccgggcgttgtcctcgtttttggagacgatgacgacggtgtcgaagaggattggcgaaaattccatgctggacgccccttgggttcgcgcgtcaggaggctgccggcgcgtgccgctcgaaataccaggtccgcagcgccgcaagatcaggcgtgtcgggcaattggtcaaacagtccctggacatggccgcgcgcaaaaaactggtttcgggtccagggataggccatgtcgtggatccagctgaggatcagcagggcgaagtcggtggcggaagccatgttttcgtagctgccaagcttgccggccaggatgtcatcgacgatggacgggctgtagcggccggtgtcgggctggcccaggaacaccacgtcgtccttagggccgtcggctcgaaaatggtcgagcatgattcggacgatgtcgagcttgtcggcgtcgcggagaaggcgcgacagggtcagtgcctcgggatcgtcaccggaaagcaaggcggcgggcaggaggcggcggttgtgcacgacgatggccatgcgcacaagggtgcgatcacgacgggacagttggccaaggccgtcgtggcgggacagcgttgccgtgcccaggcgggcgtggttgacgctttggcggtcgctgaaggtcttgtagcgccggtactgggggaaacgtccgacgtcgtggcacaggccggcgatggcggccagttcacgaagacgcggcgacagttccaggctttcggccaaggcggccgcctcgtccatgaccctgcggcagtgcaggcgcttgagttccagatggccggcgtcctggggggcatcgtcggccaggctgcggtaataggcctcgaaccaggccgaggcggtctcaaggagttcagacatggggctcgttgccggcgtcggcgtgatccacggcgtcggcggcttggcggttcaagggcgttttcggggtttcgacaggcgcttcgggatcgggttcgtcgaactccttttcccgcagcgggccgcccgggccaaaaagccagcgcaaaagccaggccatgccgccgaggatggcggcgatgaaaagccccttgaaggtgacggaccaaaaaccctcttcaaggcccggcccaaagggccaagtcttgtgccagctcggttccacggcagaggcgtaaaaaagaaatttgtcgaaaaaacccatgtattgctccatcgccgcgcttgcggcatcccgcctgacttacgcgggttcccgcctccacgcaaggaggcggggcggggcggcgattgccttttttcgcgattccacctagtttacgacaaggcgcatccatgcccctggcccgttggcgactgcggcgctgggggggagaaggacgcgtcgccggaggccgacatgcgcgttttggtcgttgaggacgatttcaccagccgtaagattttgcagaagattctcggcccgtacggcgaggtcgatattgccgtcaacggacttgaggccgtggaagcctttacccagtcgttaaacgacgccaagccctatgatctggtgtgcatggacatcatgatgcccgagatggacggccagaccgcgctcaagcgtatccgggccattgagaaggagcgcggcgtcgcgccgactggcgaagccaagatcatcatgaccacggccctggatgatcctaaaaacgtggtcgaggcctactacaagggcggagccacgtcgtatgtgcccaagcccatcgacaagcacatgttgctgcacctgatcaagaacctggggcttatcgactagttttttccgtccgtccgtccggagtgggggcggtcggacgtcgcgacggttcaagggcttgcgccgccagggcgcgagcctttttcatggtcgtcccgggccatgtttccgggcggccgcagccctccatgcaacaaaaaagccccggcccgccgtttggcggaccggggctttcgcttccatataaggatgccgggcttggcctaggcttccttcttgatcttggacttgctcatggacaggcccatgccgccaaacatgtcgaagatcgcgtagccgtaccacatggtgtagacgacgtagaagatgagcagaccggccacggtggggatcttgctcaggatgttctcggccgggatgccggcgaagttgtaggccggctcgatggccttctggttgaccatgttgacgacgttggcttcctcgatctgcttgaccttctgcaggggcttgatcatggcgttgagaagcgtccaccagcccttcatggccgccttgccgtccatgccgtaggcggcggtcagcttgtcggtctcatccttgtagaggatgtcggaatcggccacgaccttgccgagcatggctccgagatcggcggtgacgacgatgctgtcgcccttggcctcgcccttggcgccgactttttccagcagcagcacggaggtcttgacgtcctcgggggacttcatcttgacttcgacgttgacctgcttgccgtcaaaagctttgacggacttggccacggtggggatgaagtaggacgaacccttggacagcttgttgaagaggtcgtcggagaaatccagaccattctggccgcccgggaacaccggggagaagatcaggatgaacacggcgatgaagctcagcatgagcagcgcgcccttgccgaagagtttcttgtcggtgatgatcatggcccttatccctcctggcgcagggcgccgatattggcaacgaacttgccgatgacccacacgccgaacagggcgaccacgatccagaagacgatgttgccgacatattcgatgccgttgaccatctccttggacatgtccaggtactcaagctcgacgaactttttgggcagggtggaaacccggttgatgaagccggcgatgatggacatggcgtagaagccgcggatgtggatgcccttgacgaccttggtggtcagggcgccgatctggatgcccaacagcgaaccgagcaacatgcccatggccagggtgtagaacacgtagccgtagatggcgtactgggcgatggcgccaaggcccgcggtgaagatgatctggaggatgtcggtgccgacggtggtcatggaggacacgccgaagacgtagacgaacatggggaaggtgatgaagccgccgcccacgcccatgagcgcggccaggatgccgacgatgacgccgccggcggccacgatccagccggagatgcgcttgccgccgggcacgaagtcctcgtcgaaggagatcatgggggcgatgttgagattctgcagcttcacggccataccggtcatgccggaggggccgccgtggctgccgccgtgggaatcgccaccggtatcctgctggcgggaggccttgaggaagtcaaagagggcatagaagcccaggaagccgagcagcacggcgtagatggagctgatgaagaattcggacagcagcgggtccttgttgtacaggcccttgttgatggcgccgccgatgaacgtgccgccgccggagccgaccaggaaggcgatggcgagtttgaccgagacgttgccgagctttttgtgcacggccgtgcccatgatggccttggcgaagatgtggaagaggtcggtgccgacggccaggatgcccttgacgccggcggccatgagcgccggggtgatgatgaagccgccgcccgcgccgatgcagccggtgatcaggcctgcggccagaccgacggcgatggagaccaggaagatcttggtggagtaaaaggccggaccataagcggtcttgctgccgatgaagtcgccggcctcgacgaaggtgacggccaggatgggcagggccaggatcatgaggaaaagcagttttttccgattctggatgatggacgtggacacttccatgtcccacttggcgtgcgcaatcgacgccgccttcaggaactcgaagacttgcctaccgaaccccattgttgcttcctccgtgttgaaaagcctttcgcttgtccgccgcgcgatttccccaccccgcgacgccgtatgccgtaaaataaccccagccgtccacgttcccgtcatttcgcctggacttgcgccccgagcacttccccgacggcggccttgagccgttcgaaatcgccgcctttttccacctggcggtggcccagtccggcggcgtctgcgccggcgtagacatgcagcaccaccgccaggtccggatagagccgggtcagcagcggaaccaaggagccgccgtcagggtcggcgatttcgtcgtcgagcacgagcaggtccaccccgaccggcgaagccagccgcatcaggacttcggcgccggagccggcggtgacgacgccgtagccctcgcgcgcgaattcccgacgcagcagttcgcggatgttggcattgcgctcggcgatgcacagggtggccttgggacgattcacacagtgctccatgacaggattttgtccttccaaaggcaaacgccgtgccaaaacgagttccggtggaatatttccaacagaccgtattcgcaggcgtttcatgacggtggcagcaacgtgtcggaaaggtggcgaggcagccctgtcagctttttttacaggctgtcaaaagccgagggggtgtcagggtttttgccgccgttgccgtgcggcgggtcgggccttgtctggaggtgacgtgtaggcgggctggttcgggctttgtccgcgcatggcgcattttgtcggcgtagccttgcacgatgcctcggcgcatctgcccaggagcgccaaggcggccctggcggaggggatcggtgctcactgatgcgggattctatgcgctccgggccgcccgtacgtgcgccgggacgccaacgggggagcgacactagctgatacgggattcgatgcgcaggccgtatttttcgatcttggcgatgagcgtgggccgggacaggccaagcagccgggcggcctgggagcggttgccgccggtggcctccagggctaggcggatgaccatatgcccgaagcggtccatgagttcctcgaacagcccgtcgcggcccgaggccagttcccggcggatggtttcggcgatggggtcgccgtcttcgcccgtggctgcttcggctccctggcgcaggggcgcgcccagggcctttcgcacctcgtccggggacagcggcgcgccccggctgaagatgagggcttttttgagcacgttgcccagttcccggacattgcccggccagtcgtgggcggtaagcttcgccatggcctccgggctgactccggggtcggactggcccatctcccgggcatggcgcgacaggaaatagcgcaccaaaaggggaatgtccccgggccgctcgcgcaaggggggcagggccagggtcaccaccttgaggcggtagtagaggtcttcgcggaactgcccctggcgcacggcggcttccaggtcgcggttggtggccgcgatgatgcgcacgtccacgggtatgacctgccgcccgcccaggcgttcgacgtttttttcctgcaacagccgcaacagcttggcctggatggccatgggcatgtcgccgatctcgtcgagaaagaccgtgccgtggttggcctgctcgatcttgcccaccttgcggccggccgcgccggtgaaggctcccttttcgtagccgaacagctcggattcgagcagcgtctcggggatggccacgcaattgatgaccagaaagggtttatcggcccgcagggaatgctggtagacggcccgggccaccagctccttgccggccccggattcgccgcgcaccagcacggtggcgtcggtgggagcggcccggccgatggccttgtagagctcctgcatggccgggctttggccgatgatggcctcggtcgcggcctcggcgtcaacgcccacggccacgcggctgcgcatggaacgcccggcggccacggccttgtcgatgagcttcaggatttccgggatgtcgaagggctttaaaatgtagtcgtaggcccccatcttggtggcctcgatggcgatttcggtggtgccgtaggcggtcatgatgatgaccggcaggcgcggttcgatctcgcgcatggcggcgtaggcctccagccccgagatgccggacatgcgcacgtccatgaccacggcgtcgggcacggcttcgcgcacggcggcgatgccggcctcgcccgaggaggcggcgcgcacgtcgtggccctcggcggccagcaggcgctcgaagctctggcgcaactggtggtcgtcgtccacgatcaggatctgtgccatccccgttccccttcatacggaaagaccatggtgaaggtcgtgccccttgtttcgggggacatgaccgtgatccagccgccgtgctcctcaacgatgcggcgcacgatggccagccccaggcccgagccttcgcccttggtggtgaaaaagggctggaagacgcggtcaataagcggcggcgggatgcccgggccgtcgtcggacacccgcagggccaccacccggccgtagggttcgatgacgccggtttcctcgcggatgacgatggagccgccctcgaccatggcttcgcaggcgttgagcacgaggttgaccagagcttccttgagctggtccgggtcggcgctgatttccggcagccggcgcgaacgctccacggtcaccgacacgtcgtaggactccaggcgatggcgcagcagggtcagcgtcgtatcgaccaccgccgacaggctcacgggctgggccacgagcttgggcggccgggcgaattccaggaaattgcgcacgatggtgtcgatgtggccgatctcctcggcgatgacctcgaagtcctcctgctgggaagcgtcgagcttgagtccgcgctccagggaaaacaggcgcattttgaccgaggtgaggggattgcggatggtatgggccacgccggcggccagtttgccggccatggccagcttttccgattgcatcaaatggtcgcggctttgctccagatccagatgggcctggtccacgtccttttccaggtcgcggaacttctggccgatggccttgacctcgtcggacaggccggcggccacgtccttgccggcctcgccccaggccaggcggcggatggggtcgaggatctggccgaccaggacgtaggccaaaaaaaagcccaggctggcgtttaaaactacgcccatgacggccacgcccatgaccagatcggtgcgctccagatagacttggctcgtgtggcgcatgcgctcgcggtagtaggccttgtagcggtcgcagcgttcgcgcaggccgtcgaagtcctcgcgcaggccccaatgctgtttcttggcgtcgtcggcccggtcctgccggtacagggcgatgacgccgtccttggcgtcggcgtagcgccggtaggccagggcgatgtcctcgaccagggcgctggcttcggggttggtccggtcctcgccgatgcggtccagccagagttcgaaggcgcgccggctctcgtcgagcttggccagccaggccgggtcctggctcaggtaataataggtggcgtagcctttttggttgagcagggcgttttccagctcgtgggcggcggtcagggccgccagatccttgtcggccgtggtggtgtagaggtcccgggccatggaggcatagaggatcatgatgaccggcccgaccatgttgaccagaagcaggccgcccaggagcaggtagacccgggcgcgcagcccgagcttggcggtcagggatttgcgggatttggcggaggcgtttggcatggctggcggggaaggcccttggttgcgcagggttgcccgtcggcggcggtcgcggacgggagcggacgccgacagtcctagcgcggccagggccggctggcaatgaccgggccggagccgggcgggcggcctcgggacgcgacaacgcttcggtccgggatgtcggggcggagcaggccgggacggggcagggcggcctaggaccggggggacgcaaaaacgccccggcctggagggccggggcggagggagcaaaagggctgtcgccacggtcacggcggcacgaatccggtctgtcggggcgcgcctcatgccggggcgcgtctgccgacaaccgtcgtcgttcaggaaggcagggccttcttgccggaccgtgcgccgggcagggctttcacgccggagcgcgcctcgggcagggcggctggcccgccgcaggcgtcgccgcccagggtcacgatgagccggcccagctcctcggccatggcggccagggcatgggcggcccggctggtggcctcgaccccggccacgttgtcctcggccacgccgctgatttcggtgatggcccggctgatctgctccgaggcggcggactgttcctcggccgaggcggcgatggactggaccgcgccgctggtggcgtcggcgttgccgacaatggccagaatggcctggccggaacggccggccagggcgttggcctcggtgacggcggcaacggcctcatccatgccgcggatgttgcggccggcggcctcctggatagcccggatgcgcgattccacttccttggtggccaccatggtcttttcggccagcttgcgtacctcgtcggccaccacggcaaagccgcgcccggcatcgccggcccgggccgcctcgatggcggcattgagcgccaagaggttggtctggtcggcgatgtcgttgatgacgccgaccacctcgccgatggattgggcttcctggccgagatggcccatgtcgcccttgagcgccacggcgatgccgttgacggcggtcatggactcgccggcttgcttgaccacctcggccccggccacagcgttgtcgcgggtggtttcggcgtttttggcggcttggccggcattggcggcgatttcaaggatggtggaattcatctgcgtgacggccgaggcggtctcgtccacccggcggcgctggagttcgacgccggccgccgactgttcggtctggctggagagttcctgggccgcgccggaaagccggcgcgagatgtcggcggcctgttcggccacggtcttcatgcaggataaggtcttggccagttcctcttccttgcgcatggcctcgcgcatggcctcctcggcggcctgggcgctgcgtgcggcctcggcctgcttctcctcgacttggcgcatctggactttcaggttgtccaccatggccgtggtgtcgtcgcgcagggcggcgaattcggcctcgaagcggccggcgggcttggcctccaggtcgcccgaggccaccttgcgggagtaggctcccagggcggccagggaattggagatgccgcgcacgatccataggatgaccagcagcacgaccacggccaggccgacttccacggcgacctgggcccggtcaacgatgtcgtcggtttcgtggcgcttgtcggcgtaatgcttttcgatcttctcgaagggcggcatgagcttgcggccgctttccaccatggccgccgtcacctgcttggccttggccgaagcatcgacataagccatgaagctgcgctggtaggcgtcgatgacggcgtcaaagccctttttctgggcggcagagaggtcttcggcggcggcgaccatagcgtggagctttttcacgccgtcctggaccttgacgacgtaggaggtctcgtcacgcagctgccagtttttttcgtggcggcggatggtgagcagcaggatctggaaatccttgtcggcgatgggggcgaatttgtcgtcgaggtcccgggcggcgtagacgaaatcccgcatgatgccttcatgctcggtgaagcccttggctttttcgatggcggccagctcgtcaaagctttttccgtaggcggtcagctcggccagggcttgcccggcctcgccggccagggtgttgtcgcggcgcaggatgtcctcgacattggcccgcaccttgccgatgtgctggctgacggcgcttacggtggacgggtcgtggcgcagcaggaaatttttctcctcccggcgaacttgcagcacttccacgtaggcgttggccgccagctcttccaggttctggtaacgctcggtgtaatggctaccgacctgatccgccgcgaacaggcaggcaaaccccaggacgcatacgcctagcagcaggtacaacttgctccgcactcccatcgcatcctccacggttaggcaaacccgccgtcgtcatcgcggcgacatgtcgtgctttctatactacaaaaggctgaaagtcatgaaatatcaaccatgcaaggccggggccaaggattgattcggcgtaaatgtcacgaatcgcggtccgggacatgtcgaatcatcaggaggaggcgcgccgtggggtgtggcaggtgtcagcttatttgacaggttgtcaaaggcgagcggcgtttgtcgcgacgcggtgacgaaagatcaaggctgcttgcgctgcgcgtcagggcaagggcggcgggcaataaaatccaccacggcggcggacagggcatcggggaactggtgcatcatccagtgggagccgttttccaggacttccagcctgacattcgagccgggcacggcggcgtagctgtcccgaagggcttcggacagccgaagcggacacacccagtcgtcgctgccggccaggatcagcaccggcggcgaggttttgccaagccggccggccaggcccggccagcccagcatggctgcgtactgccgggacacggcggccaggtccagcgggcgcgtccgtggcctgacccggcccgccgcctcgggatgggccgcgctccaggcggcgggaaacatgctggccaggatgtcctccggtcccatggccccgagccggtcggcggcgggccgcaccgaagcgaactcgccggaggtgcccagaagcgtcagggaacagaccgcctccggccgagacagggcgatttcctgggccaccatgccgcccatggaccagccgaggatgtgggctttttcgatctccagaccggccatagttcggaccacgtcatcggccatggaggccagcgagatgtccgccgcctcgcccaagggcgtttcgcccatgccccggtagtccaaaagcaccagccggtggcctcgggccagggcgtctatcaagcccgcgtcccacatttccttggtcatggcgtagcccgtcagcaggaccagggtcggcccctggcccatgaccaaactgtccaggggcctgtccggcgaggcggcgaggtgatgcggggcggctgtggcgtcggccccaagggattcggcggcggtctgggacggttgcgccagggcctggccggtcgccgtcaaaaggagcaaggccagccatatgaggccggcggcaatagcgtgttttggtcgtttgacaaggcgtgcggtcgtcatggcttcaccaatagagtggatgtcggaagtgagattggataaccgggctttcaaaaggacgccgcctttcggaagccgcggcaacggtggttcctcttaaaggcgaaccaccctgtatcacttttcccgtcgagggggtccggggggatcatccccccggtgggtccagggcaaagccctggccgccggaggcgttccctcttcaacgattttacatgtccctagggactgaccaggatgacgacgcggcggtttctggcctggttttccgggatggaccggccggccggatcggtgttgggggccacgggctgggtgtcggccaggccttccacgcgcaggtggtcgcgggccacgccgtggtcgatgaggaaccgggccacccggctggcccgggccgaggacagctcccagttgctggggtagagccaggattccatgggtaggttgtcggtgtggccttcgacggtcactttgtagggtgtgccagccagggtggcggcgatgtcgcgcaaaagcggaatgccgccgggtttgacctcggcgctggccagatcgaaaaaggccgcgccgcgaaggttgagttccacgccgttgtcccggggccgcacttccacggctccggccgtgacgtcgagcttgccggagagttccttgcggatgtcgtcgaggcttttgcgggtcgggccggtgcgttcctcgccgggtttgggagctttttcggccgtggcgtcggccgtggcgtcggccttggccggttcggtccccttgggctgttcgccgggtttggccgcctcgggcgtcttggccggctctccgggcttggtcggttcagccgccttggccggctcttgcggctggccggggtggggctcgccgagtttcgaggcgtcggccgcctggggcccctgggccggctgctcatagagcggcgcgggttcccgggacagggtcgtgtggctgaccttggagcgcacttgcggcttttcaaagggcaggggcggtggggcggttttgtccgtcaccggcgcggtctcggctgtttttttcttgggcgcgggcttttcctggaccatggcctgctgcatggagtcggccacgcgctcgtagcggttgaggtccacgtgggacacggccacgatgagcaggaaaaagcacaacagcagcgtcatcatgtcggccagggagatgggccaaaggtcctcgtcctcgtgacggcgcttgcgcagatcggacagcttgaacatggcggcctaggcgtcctggccgaagccttcgccggcttcggcgcggtcgatggaggcccagcggcgcggcggcagataggccttgagcttgtccagcacgatggcggccggggtcttgtccttgataaacagcgtgccgtcgcgaatgacgcacatgaggatcacgcgctcctcgatgcgcttttccaccttgatggcgatgggcaggaaaatgaggttggacagcaggatgccgtacagggtggtggtcagggccacggccatgtgggcgccgaggttgcccaggcccacgctcatggactgcatcatgccgataaggccgataagcgtgccgatgatgccgtaggccggggccagcttggccatggtgcggtagatgccggctgaggacagctcctgctggtaggtctgctcgatgcgggtgtcgaggatttccttgatctcttcgcgggaatagccgtccacgagcatttgcacggcgttttgcaggaattcgttttcgatgccgggcagggcctgttccagatggatcttgccccggctggaggcctcccgggcgatggagacgatggcctcgatgtagtggtcggtgggcagttcctcgcgcttgagcgccgtgagaaacgtgctcgacacccgcatcacttccttgagcggaaagcagatgaaggtggaggcgagcgtgccgccaaggacgatggccaggcctggaaaattgacaaacactccggcgctgtccgtggacaggtaggtggcaaatcccaggatggcgacgccgaagacgatgccgatgacggtggcgatgttcacgaggcgagtcccttggcggccttgatgcggtcgagcagttcttgttccacggcggcggcctcgccctcgtcgagggcggccatggcggcggcttcctcgcgcacgatgccggcaatttttttggagagcgtcttgtagatcttgtcccgggcggcttctccggccatggccgccagcaccgccaccttgtgaaagcccatggtcgagagaatttcttccagggtcgcggcgtccacggccacgatgtcgtccacgctttcgaggtcggcggcggtcaggcgcggtcggcgggcctgcttgaaatactcctggcccatggactcgatgaattcccgggcggcggatttgtggaagaaaaagagcttttcgggaatctcgccgtagccgatctttttgaggatcacctcgggcgtgccgccggcttcccgggaaaaatcggccagatcgcaaaattccagatccacgcccacggccttggcgttggcgtcgtcgcgggagagattcttcgccacggccagaaatttctcgggatcgggcaggcgcagacggcggtccttgatgaagctcggcccgggtttggtcttgcccaggaggttcgtgcgcgggaaatggcctttgacctcggtgactgacacgaggtgcagttttttgaggcgctcgaaaatggcgtcgatctcgatctggctgagaaggatgatgtccttgatggtccgggacacctcggcgtagtcgagttcggctttgtccccgcgtccggccgcctgccaggccaggtggacgatgcggcacacggccagaaacgggtcgcccgacggccggtccgtgacctgggcggccagggcctggacgcgctcggccagatagccggccagcagttgcaccggacgggggcttttgagcagcatggtctggatgagacgtttgtcgcaggccagggcctcgacgtattccacggcctcggccgtgctggctcgcggctcggccgtgaccacgcccatctcgccaaacatctcgcccgggccgcgttcgcccaggcgcacgcgcttgttgccgaccacgcggtagatggagacgcggccttttttaacgacataggccacgtcgctggcctgtccctcgcggaagatgacggttcccttggggaaggtgcggacggccgagtcggcctcgtcctcgaagcggtcgatatcctggggcatacgtcctcgcgttggcggcctcgggccggttgcggacacactacggccaaggccggccgagttcaaggacggcggcccggctgcggtcaagtttgcccgccatggcccgttttacatcaaacgccaaaggcggtataggaccgccacattgttcacgcgaggtgctgtgtggctctttccggcgcatgccgcgacctgaccatcctgtccgtcaccgaagccggaccggaaggcggggcgcatggctgttattacatcgaactggccaatcccgggcttggctcggccgtggccggccagttcgtcatggtccggccggcctgcttcggccaggacccggtctggcctcgtccgttttccatctgccggctgaccccggaggcgctcaccctttttgtccaggtctgcggccggggcacggatgtcctgtgccggctggttccgggcgacacggtgacggtctggggaccgctgggccagggatttagtctggagccggacacgccgaccttgatgctggccggcggcgtgggtctggccccctttgtggaatacgccgccacccacccggccccggccaatctggatctggtcttcggccatcgccagccgctgtcctgctatccctttgccgagatggccgctgtcgtcggccgggcccaggcgtttcaggaaaatactcccgaggatttgccccggttcattgaactgctggaaaccaaagtggccgagtacgccggcggactcattgtcgcctgcgggccgcggccgtttctcatgaccgtggcccggctggcccggcgcttcggggccagggcccaagtgtcgctggaaaaccgcatggcctgcggcgtgggcggctgcctgggttgcgtggagaaaaacgccctgggccagtacgtgcagacctgcacccaaggcccggttttctgggtcgaggaactgcagctctcggaggaggcatgagcgtggacaccagcgttcgcctgccgggaatgcccgtcaaaaacccggtcatgaccgcctcgggcacctttggctacgggttggaattcgcgccatacggtgatctgcgcagccttggcggcatcgtggtcaagggcttgtccctggccccgcgcctgggcaatcccatgccgcgcatcgccgagacgccctgcggcatgttaaacgccatcggcctgcaaaactgcggcgtggaaaaatttctgcgcgacaagctgccgcgcctgccttggcgcgaaacgccgatcatcgccaacctctacgcctgcgacgccgacgaattcgccgagctggccggagtgctgtcggccgaggagggcgtggccgccctggaggtcaacatctcctgccccaacgtcaaggccggcggcatcgcctttggccaggacccgtgcatggccggcaaactggccgaggccgtgaaaaaacgtgccggcgacaagccggtgtgggtgaagctgtcgcccaacgtcacggacatcgtgtccatcgcccgggcggcggtgctgggcggcgcggacgccctgacctgcatcaatacgctcacgggcatgagcgtggacatccgctcgcgcaagccccggctggccaacgtcatcggcggcctgtccgggccggcgataaagcccgtggccctacgggccgtgtggcaggtctgccaggcggtgtcggccccggtcatcggcgtgggcggtatatcaagcgccgaggacgtgctggagttcattctggtcggcgcccacgccgtgcagatcggcacggccaacttcatgcggccggacatggcgtttcgcattgccgaaaggttgccgcaactcatggcggagctgggaatagaagacctggcctcgtaccgagggagtttgcgggtgggttgagcgcggcgcgcgagaaggattttgcagcggcggggcggagacgtcccgccgtttttttgcgccatgcggcaacgcggtgttgcttcggccggcagcaggcaaggcgtcggcgggatggtcaggaaacggcagcgtccgtgtcgtccaaggcggtggagaggattgctgcctgacggcgataggacaagacggttgttttggtgcagtttgaagacagtagttgccgcaaatcccctcgtcgcgtaaacctcacaataaatggaaactgtttttgaagtactttggtcaagaaagtaaggggaatgcccatggataccgccagcgccgacgagcgacacaagcaggctgtacgccaaaccatccaggaaaacgccaaactctgcgtcgcgtttatggtgatgaacatgttggccgcgacaatcgccagctatggcctgtttgccaacagtccggccgtcattatcggagccatgatcatcgccatgctgcttgggccgatcacgggcgtctcgctggccctggtcgacagcgacatgaaggcgttgtttcgtggcgtaggcacgctgttggtaggcgctgccggcgtcatcgccacggcctacaccattggctccattcacatcgacgtgcccattacggcggaaatactcggacggacccatccgaatttcgcggacctcatgatcgccctggccggcggggcggccggcgcgtacgcctcggtatctccccgcctcagcgttgccttcgtcggcgtggccatcgccacggcgctggtgccgcccctttgcgccgccagcatcctgctggcgcgcggccagcaccaattggcgtttggcgcgtttctgctgaccttcaccaacatcgtggccatccagtttgcctcgtccgtggtgctgttcgtgaccggctttcggaaggtcagcgaggccaagggattatctttcttgcagttcttgaagttcaatttcgtgagcatcgccatcctggccgttttggccgtggtgctcaccgacagcatgcgcgaagtgctttccaagaagatctatgaagccaatgtccgcagcgtgctggaacaggagtgcgccgcttcggacggatgttatctggcggacatccgttttggccaaggcgggaagcaggaaaacgtcattgccgccgtcattcgggggccgcagccgccaacgccggaacgcgtcgcggccattgaaaagaagcttcccgcccatcccaagggcctgactgtagagcttcgggcgcggtatgtgccaacgacgacgatcagccgtgacggcgttcttttcgaagacagccaggaggacgacggcaagccgtgaccgcaggcggtacggccaacttcatgcggccgggcatggcgtttcgcatcgcgcagcggttgccggagctcatggcggagctggggatagaagacctggcttcgtaccgggggagtttgcgcgtgggttgagcgcggcgcgcgcgagaaggattttgcagcggcggggcggagacgtcccgccgtttttttgttcgtgatagtctgtcagccgccgcaagcgttgccgctccagcctgctccggcgaggcttgggcaaccgatttccaaaattgatcaaagcgcctgcctccctcgccttggcgagtcccgccctaggcctgccccggttgcattcccgcccctttgcctccggtctgccataaatgtctgacgcaacgaccaggacggtcgttttttgtccctcggtcattacaactctgaaaggttgccgccagctccgctgacagtcggcagtcccatcgagcaaacctgcacccccgtgctacgacacgccgcctgatcgctaacgtcgcgcgccagtccacgcccaaggcccgccggataaggcctgacgacccggcccgaagcgccgagcagccgtcctgctgccgtgccccgggccttcctccagacgatccccagcccggcgacatcccaaaaacgcatcaaattcacaatcgcgtacatttgtcgcgacgcttttcccgtgctagtgggccgccaaacttttttgggggggtcggtatgctgcaaagcggcgatacggcattcgttctcatcagcgcggcgctggtgctgttcatgattcccgggctggcgcttttctatggcggcatggtgcgcaagaaaaacgtgctcggcaccatcctgcaaagcttcatcctcatctcgctcgtcaccttcgagtggatctacctcgggtattccatgtcgttcgggccggacgtgggcggggtgatcggctccctggcctgggccgggcttgggggcatcggggccgcgccctcgccggactacgcccccaccgtgccccatctcgcctttgccatgtaccagtgcatgttcgcggccatcaccccggcgctcattaccggggccgtggccgagcggatgcgcttcgggccgtttctggtcttttccctggcctggaccgtgctcgtctacaacccggtctgccattgggtctggggcaacggcggctggcttaaggaaatgggcgtgctcgatttcgccggcggcatcgtggtgcatctgacctgcggcgcggcggccctggcggcggtgattctcaccggaccgcgcaaggatcacggcaagcatcagatcgtgccccacaacctgcccatgacgcttttaggcaccgggatgctctggtttggctggttcggcttcaacgccggcagcgccctggccgccgacggcgtggctgccggagcctttgccgccacccacatcggcggcatggccggcatggccatgtggtgcgccatcgagtggtatcaccggggcaaacccaccaccctgggcgcggcctcgggcgcggtggccgggctggcgaccatcaccccgggcgcgggatttgtctcgcccggcgcggccgtggcctttgggttgcttgccggcggagtgtgctacggcgcggtgctgctcaaggcccggctgcgtttcgacgacagcctggacgtggtcggcatccatggcgtgggcggcgtgctcggctcgctgctggttggcgtcttcgcctccaagctggtcaacccggccggggccgacggcctgctcgccggcaacgccggccagcttggagtgcagctcttggccatcgccgtggtcggcgtcttcgccttcgtggccagctgggtcatcctggcggcggtcaaggcggccatggggctgcgcctgacgccgcaggccgaaaccatcggtctggatctggcggaacacaccgaggcggcttacggcgaataatcgccgatagccttacgcttcctgctgccgcgtaagcccaggcggcagcaggacttcccgggagggttatgaagcgcgttacagccatccttcggccgtctcggctcgacccggttggggccgcgctgacggaagtgggcctgcgacatggcggttgatgcgctccagcgcaataattctatcgtatgcccctgattcacggctcctgcgcttcatgtcagaccgtgctcagcttttgtcatggtgaattcgacaagcatctgaacatccgggcctcgtttaaataccttttctggtggcgctccctggaaatcacgaggacgccactcgcggcatgtattgatctctagccgtagatctgctgctgcgttgatgtaatcggagaagtggtgcggaaaggtcggcatccgtacaatatcgttgccatcgcggaaatgcgcgctcacattgccaagcgacatgaaaggatgtatttcgatcacaatgatctttccgttcactcgcagaaggcgacgagcctcccgcaggggcgggaccagatcgctgacatgttccaaagccaaagaaaatactatccaatcggcgattccatcggccagcggaaatgcctgcgtcatatcctgctgcacaaggatgaatgcaggatcacgtgcacgggctttttccagcatgcctggcgaaacatcgcagccgatgagtttttcagcaccaccttgctttagtctcgcaagattccgacccgtgccgcatccaaactccacgacggtcttgccgccggcgtcgttggctaaaaggtcgatagcctggctcgcgccaaagaccattggattatcgtaggagtcatagaaggatgcccaccaatcataggcctgcgcgacggggagaaagaggttgtttttcattcgtgtaggtttccatgcatgccatcgaccggagacgatacatgcaaacgttcagcccgccgcggctggccattgaggatacgatactggaagggatgcagcgcgaggctggtgcgggcaagacagtgcagcttgacggcaaagagtgacgcccgctttgccttggcaattgcaacgccataacggcaatggcgctctaccgtgacatgaagcacgggcagagagtaagtggcaaaaaaagcgagatgcgcttgacggttatacatactacttcccgttgcgagaaaccgtctcgctttcggggcaagtagttttccggctatgccgttcagctccgccagagcaccttcttggtagtgtttgagcgttggtctgtcaacaaaattgggccgttgggatgttggtgggtacggacactcgcattccctacgcttcgcgcaaggcctcgacaatccccaggcgtgaggcccgcagggccggcagaaatccgcctacgacacccatgaagagcgaaaacgccaacgacagcgccacgatccatggggccagggtgaagcggaaggccagctcggagaaggtctggaagttggtggtggagaaggtgagaaaggacagcccggcggccaaccccaccccggccaggccgccgatcagcccaaggagggtggattcggccagaaaggcgagcagcaccgccccgcgcgtgaagccaagggcgcgtagcgtgccgatctcggccacgcggccggccaccgaggcgtacatggtgatcatggccccgatcatggctcccagcgagaaaatgagcgtgagcgacacgccaaggaccgtcaaaaacttccgcatcatgtccgactgcttctcgtagtagcgcgtctcgcgccagacctcggcctgcagcctcgggtcggcttccaccgcctccttgaaagcatcaaaaagcccgggttcgcgcaggccggccaccacgatggaataggcgttgcggccaaaggccggcatgagctggtcggcgtcgccccagatctccgaggaaaagccggtggagccggcgtcgaacacgccgacgatgggccattcccgcttgccgaagcgcaggctttggccgatttccgcgccggcgaatcccttggccacggccttgcccaccatgatttccggcgtgcccggctggggcgcgcggcccgacaccaggcgcacctggccgcgaagggccagcgaggccggctccacgccccggatgaccacgtttgaggtcttgcccgtggatttcttggtcagtccgatgagcaccaccgactcccgggcggccaggggccggccgtcgccgcccggggcgatctcggcccgggcggtcatggccgaggcctggacgcgctccagcccgctttgcacctcggtctcggaacccttgcgcagcacgatgacgttgccgggcgagccggtggagacaagcgtctggcgcagtccttcggccagcatgagggtcgccgtgaagacgaagaccaccagcgccatgccgccggcggtgagcgtcgtggtcagccggcgggtgacaaggtttcgccaggaataggacaggggcacggccatcagccgatcctccgaaacgcgtcggcgatgcgcacggccgacacccgccaggccggcaccgcagcggccagcacgcccacggccagcccgaaggcggcctggagtatgatggttgtgggcgagacgaaaaagatgggaaaatactgggccagccccacggcaaagcccttggccagaggcggcagcacggcaatggccagggccgtgccggccagggccagcagcatggactcggccaggagcattccggccagagccggcgcgccaaagcccaaggttttcaggaccgcgaactcgcccaggcgttccctcgccgacatggccatggtgttggcggcaatagccaggatgatggcgatgaccacgtaggacacggcggtgatggccagcaaaatggcctcgctcatggccacgaacccgagctggaaggcgcgctcggtttcggtgagggtctcggcctgggagttgcggaacagcgcgtcgatgtccttggatatttccgccgcgcgggtggcgtcgcggatgccgatcatgaaaaagccgacctggccggctcttctcggggagcgttttttcatggtctcgtcgagatagccgtagtggaaatagaggaccgtctcgtcggtgtccgggcgtgcgcccttgtagatggcgcggatggtcatgggccactggcccggatagatggtgccgcgcagggtgacggtgtcgccgatgcgccaatggaagcggtcggccagcttgcggccgatgacggcgctcttgcggtcggtcaggaaggccttttgctcctcggggctgacgatgagttcggggtagagcctgaagaaatcgtcggtctcgaccacgaagttggggaagaagttcttttcgtcgagatacaccccgccgaaccagccgccggcggccacgatgtccacgcccgtcacctggcggatgcggcccttgtaggcaaagggcaggggctgggtcagcgacacggcgttgcgggtgaccagccgattggccgaggaggcttccaccccggcgtgccaggcgtccagcaccgtgcgcaaaagcccgaacgcggtcagggccacggccacgccgacgatggtcagcacggcgcgcaggcggtggcggaaggcgtttaagaggatgagcctaaggagcaacacgcagttcgcccttgtcgagctcgcgcacgaggtgggcggcctcggcggccttgtggtcgtgggtgaccatgacgatggtcttgcccaggtcggcgtttaagcgcttgagcagggccatgacgtcggcggccgagaccctatccaggtcgccggtgggttcgtcggccacgatgatgtccgggtcggtgacgatggcccgggcgatggccacgcgctgctgctggccgccggaaagctggttgggcttgtggtcggtgcggtcggacaggcccacggcggccagggcggccagggcgtggtcgcgccgggcggcggcggacaggcttgtgagcaaaagcggcagctcgacgttttccagggcggtcagcaccggaatgaggttgtagaactggaagataaagcccacgtggcggcttcgccacacggccagttcgctttccgacaaggtggcgatgtccgtgccggccacggtgatgctgccggcgtccagggaatcgatgccggcgatgcagttgaggagcgtcgatttcccggaccccgacgggccgatgagcgccaggaactccccggcagcgatgtcgaaggtgatgtcggagagcaccgggatcacctgatcgccgcgttggtaggatttcgacaggtgcgatatttcgataagcgggcggtccatgacggattgtcctgtgcctgggagacggcctggcgtcgcgtcccttaaaaaatacaacagtattttttaagaaaacaatggttttcgtctgttgcctgtgaaacgccagaggcgtcgctcgcgaacacggcctagccttcggccagggccacggcgtcgccgtcgcgcagttcggccgggggcgagaggatcactttttcgccggccgtgagtcccttggccacggcccgcatgtcgccgagtgggtcgcccagggtcacgggagtcaagacggccttgccgccgcgcatgacaaagacggcgtcggcctcgccccggcggatgacggccccggccggcacggccagacgcggctgggtctcgtccggggtcagcggccgggtgagaaaggccgtcttggcgctcatttcgggcagcacccggggatcgagggtggtgaagcgcaccttgaccagcacggtggccttggtgcggtcggccgtgggcacgatcatgtgaaccacgcccgggaaccgctcgcccgggatggcgtccaggatgatctcgcacgggccgcccaccttcaccttctcgatgctcgattcgctaacgtcgacctcggcggcaagggaagacatgtcggcgatggtgaccacggcggccttggaggtggacgacgcgccaaggggcgagatgatgtcgccgaggtcggcgttcttggtgagcaccaccgcgtcgaagggcgcttcgagttcggtgtagccgcgctcggcctcggcttttttgagcgcctgctcccgggcggccaggctggccttggcctgggacagggcggcttcggccttgtccagccgggccttggctgcgtcgtgctccgagcgagccacgtagtcgccggccgagagctttttcatgcggttgtactgcagcgtggcgtcggccagctcggcttcggccgaggcaatctggaaccgggcggcggaaagctcgtggacggcgagctttttggccgcttccacgtcggcgctttccagccgggccaggatgtcgccctttttgacgcggctgccttcctccaccccgagccagacgagctgggccgtggccttggtggccagggcggccttgcgctgggccacgatgtaaccgctggcggtcagttccgtgaccgtgcgcgagggataggccaggcccaccgtggccgcctcgaccacgtaggtgcgcggggtcatgaaccagccggccagggccaggaccaccagggcggcgacgatccagggccatttcttgcggcgtcggcgcgcgccggccattttgtcgtcgccggcaatgcggagattttgcagcgtgtcgctcatgggatttcctgtatctataatgatgacgggtcaataccgcgttgtcctgaagagtcaagacgaaataattgcctggaagtttcgtcgggaatgttgcgccgtcagcgcaacggtggttcccggcaagggcgcgccatgctttttaaccgacctggcccccttacacttttcccgtcgagggggtccgggggggatcatcccccccggcggagaggtccaggagaggccgcgcctctcctggccgccggaggctctccccaaattgctcgatgagcttgcggtggccggccggaaaggcgtagcgcgacagctcgtctggtgcggcccacaggctttcctgggcggcggtcagggttggctcggggggcggcgcggcctcgggcaggtcggtgagccgcagcaggcagcagtgcagcgtcacccggtaggtggtgtagccgtggcggatgacggccagtttggtttcgacccgggtcgcaaagccggtctcctcggcgaattcgcgcaccacggcctgttccggggtctcgccggcctcgatgcggccgcccgggaactcccacagattggcccaggcccccttgggcaggcgcttttgaataaatatgcgcccggcgtggacaagcacgccggtggcgacgtcaagcggcgtgatgtccttggatttgctgaggaccggccggtcgggcacgatgttcagacgcctggccgcgcaatgcccggccagggggcaggccggacagtccggggtgcgggggcggcagaccagcgccccgaattccatgagcgcctcgccgtagtccctggctcggccgggggggagcagttcccgggccagggtggtggcctgggccttgccggccggttccttgatgggcgcgtcgatgtcgcagacccgggccagcacccgcagcacgttggcgtccacggccacttcgtcgcggccaaaggcgatggcggccacggccccggccgtgtactcgccgactcccggcagggcgcgcagggcggcgaagtcggccggcagccggccgccgtgctcggccatgacccgccgggcggcggccagcagattcctggcccggctgtaatagcccaagccctcccaggccttgagcacctcggtctcgtcggcttcggccagggcggccacggtgggaaagcgggccgtgaagcgctcgaaatagacggccacgcggtccatctgggtctgctgggccatgacctccgacacccagacaccgtagggatcgtaggtgcgccgccagggcaggtcgcggcggttttgggcgaaccaatcgagcaggagcggcacgaaatcggcgttctcggacatgcatacctcatttgccgggctttgacccccggtcggaaactcgcgccctagcccataatgccgattgggccggctgggaagggcggggactcgggaaggccggagaggggcgaaagccgggcaggtccaagggggctacacgcctgaggcaacaggcggcgcgttgccattgccgccattttggcccatagcaggatgactggcggtccggccgccggggaggaaagccatgtccaagtccctgtcgcgccttgtcgtcgtcctcgctctggtccttgtcccatccctggcccgggccgccgggccggacattcctccggccctggccccgtgggtgggctttgccctgtacgaggccgggcagcgcctgtgtccgccgatgggcaatcgcccggacgtgcgggtctgccggttccccacaagcctttctttggacgtctggcccaccggcgcggacatgatctatacggtgcggctttttgacgacggcccggttcctctgccccatgccgccggggcctggatcgagggcgtacgtgaggggggagccgccgtgcccgtgcttggcgcgccggacgcgccctttgtgcggcttgcggccggggaacatgtcctgaccggccgcctgggttgggcggcaacaccccaggggctggccctgccgccggatgtcgggttggtgcggctgtcccgccagggcgcggcctcgccggtggctgtttcgccggccggcgaattgcgcctgagcccgcccgaagcggccaaggccgcgcccaatcgtgagacggtacgcgtgtttcggctcattgccgacggcgtgcccgtcaccgtcaccacgctgtatcgtctggaggtgtccggtctggcccgggccgtgaccctggccggggccgtgcccgccggagccttgcccctggccgtgcgcgccccggtcccggcgacccttggcccggacggcgggcttgtcctcgacgccggccctgggcgctacgaagtcgaggtcgtggcccgctatccggccaaggtggaccgcatcgggccggccgtgtgcccctatggccgggagatctggagcttccaatccggcgaggtccgggaggtccggcccgaagggctacccggcatcgaccccaagaccgccgacgtgcccggctcctggcaggcctatccggcctttgccgccgaggctggcggcgtcatgaccctggccgagcttgggcgcggcgcgcccaccggccgcgacgcgctgacgctgtcccgcgagatgtggctcgatttctccgggcagggcctgtccgtgcgcgacacggtgaccggcgaaaaccggcggggctggacgctttccctgctgccgcccggggagttggggcgggtgacgatttccggtcaggaccagcccgtggtacgcctgggccaggacggccggcctggggtggagctacgccaatcgcatctcaacctgacggcgcgctcgcgctatcccgccgtgggcgcggccctgccggccgggggcttcgaccgggagttcgagcgtgtttcggccacgctgaacctgccgccgggctgggccctggcctatgcctcggggccggacacggtgacgggcgggctgctgtcgggctggacgcttcttgatctgtttctggttttcgtgctggccgtggccgccttcaccttgcgcggacccttggccggcgtggccctggggttgtttttgctcctgtcctggcatgaaccccacgccccgaccacggtctggatgttcgtgctggccggcctgggacttttgcgggcggccggcgacgtggggcggctggccggctatccggcttttcgccgcctgtccgtcacgctcttcgttttggccatggcgtcgttggtggtcttggccgtgccctttgtggcccgggaattgcgtctggccgtggctcctcagattggcggcgggggcggcggcgctcccgtgcccgtggcggccaagcgccaggccgccaatgaggcggccatgtccgaaccggccgtcgccccggccccggccatgccggccgccccggcccgaggcaagagcgacgccggatcgcctcggaccatggccctttacggcggttatgaggcggacaaggccccggaacgcctggaatttgatcccaacgccctgatgcagaccgggccggccatgccgtcctggcatttcacctcggtgggcctgtcctggcgcgggccggtggccccgggcgagaccctgcacctgacgcttgtgccgcctctggccacggccggcctgggctttgcccgggtgattctccttgggctggccttggccctgctgttcgaccgccaacgcgtgcgccgtctgacccagccggcggccgtggccggggcggcggccgtcctcgtcgccgtgctgtcccttggcctgcctgagcgggccgcagccgcggatttcccgccccgcgaccttctcgacaccctgcgcgagcgcctgacccagccgccgcgctgtctgccggactgcctgggcgcgcccgggttagaggtgcgcctggaggccggcacgctcaccatcgtggcggctatcgacgccgccgcccgggtggccgcgccgttgccggccgtgtccgagggctggcggccgacgctagtcaccgtggacggcaagccggccggggggcttgcccgcctggacggccagccggccgtgctcctcgaacccggcaaccacattgtggccatggccggcccggcccccgaggccgtgtcctttaccgtgtccgcgccgctggcccccgggcgcgtccaggcctcggccccgggctaccgggtacgcgggctggacgagcggggggggctggccggtcccctggaattcgtgcgggccgagaccggcggcaaggcccaggcggccaagcccggggccacgggcatcgacgtgccggcctttttcgaggtgcgccgggccgtggatttcggcttaacgttcgaggtggcaaccgaagtcgtgcgccgctcgcccaccaccggcccggccgtggccgttgtgccgcttctggccggggagctgcccgacgtggccggggtcagcgtggagggcggcaaggccacggtgcgctttactccggggcaggaccgcgtgtcctggcgctcgcgcctgccggccgcgccgtcgctgaccctggccgcgccgaccgacgccgccctggtcgagacctggaccgtcaccgccgccgccctctatgacctgtcctacgacgggccgccgcccgtagcctggctgacccccgagggccggctggccccgcgctttgcgccctggcccggggagagcctcaccgtgtcggtggcccgccccgagaccgcgcccggggagttcctgaccctggagcggggcagcctgtccgtgcgccagggtggccagtaccgcgaagcgacgctggttctggtcttccgggcggccaagggcgcgcgccaggtcgtgaagctgccgcccggggccgaggtcacgcggctggccgtggccgggcgcgaggtgttgcccaccggcggcccggacgaggtcggctttgccctgccgccgggcgtcaccgaagtgaccgtcaacttccgggagaagcaggggatggagaccttcgcccgcaccccggtcattgacctgggcttgcccgggtccaatctggccgtcagcctggagctgccggccgaccgctggctgctggccgtttccggcggcacgcccctggccccggccgtgctgtactggggctggctggcggccgtggccgccttgggcctggggttgtccttcatgcccgacacgccgctgtcccgcctgtcctggctgctctacgccctgggtctgagccaggctacgcccggcaacgcgctgttggccgtggcctggatcgctgccctggcctggcggcggcgacatcccatcgcccagggcgcggtggccttcaacattgtccaggtgttgctggtcctgttgaccctggccgggctggaggccctctacgataccttgggcacgggccttctcggcctgccgcgcatgcaggtggcgggcaacggctccacggccacggccctgcgctggaccttcgaccgcttggccggtgcgttgccgtcctgcacggtcgtgagcctgccgttgatggtcttccgtgccgtgatgctggcctgggcggtctggctggcctgggcgctcgtcaagtggctgcgttggggctttgacagcctgacggccggcggcggctggcgcaagcccgaactgaagctgcgcctgccgggcctggggcgcggggccgcgccaaagccaggggagccggacaagccctgatcgggcggcacgaaacttgatgctgtcctcccgcccggcacgtttggccgggcgggaggttctcatggatgccggacactgcgcggtttgcgggaatcccatcgaattcatggacgtctacatcctgcgtgcccagggcaagatctgcagccggtgcgtgctgtcccggggcatcccggtttcgggccgggtgtcgcgccaggccctttggcgcggcgagtgggcgggaaaggactgccggccgcagctgggttttgcccaagggtgattttaccccctcgggcagaccggttttgccatttgttttcgaatttgctagagtccccttgttcagttttgcacatacttcggcacaaggggtacccggctcatgcaacttaccacgcgaagccgctatggcttgcgcatgctcctcgacatcgccctgcacggcgacgaggggccggtccgcatccaggacatcgccaagaggcgcggcatttcggtcaagtacctggaacagctgatccgggcgctcaagaaagcgggatttatcaacagcaagcgcggtcccaagggcggccacgtgctggccacgccggccgaggccatccgagtcggcgacgtggtgcgggccctggaaagccggcccgaactcaccgagtgcgtgggcaatcccgaggtctgcatgatctccacggactgcgtcactcgccagatctgggcccgggccaccgagagcatcttccgcgagctcgacgccatccacctctccgacctgctcgtccaggcccgccgctccgagattctcggcctgccctgctgctgagacgcccgtcgcccgcccggccacgccgcccggtcccgtcgttcgctcggccccttcgcctgcccggtcgcgcccttgggctacgccgccacttggtcacgccgttgctcgtccaggccaccgctgggccacgtcgtcccagccgttgcggcaagccgtcgcctcggttcactccgaccggagacacggggagggacggaccttcggggtggcaatgtcttaagcggcgtggccttcctgccgccgcgacaggagtgcccttgcccgggccgcgccttggcccatggccggccaatgacaaacgccgccgccttcgttggaaggcggcggcgtttgcgcgtccgggcgtgggttgccgaaagggccggggattacagggcgtagcgcagggccggcacggccgggatgaggccaagctcccggcagtggtgggcgaaaagcacgagacttgcggcagcggccgcgtcgaaatcgtagttgaccacccggaagtagtcgagcagcgcagccgggctgatccagtcgggcaggcccggggccgtgacaagctcgggcaggcgctcgggcagcgccttgttcgtttcgcacaggaatcgccgcaccgcgtcaagggtggccagggagcggccggcaaggccttcccgcacgatccacagggcaaaaacgaagggcgtgccggcgaattcgagccaggcctggcccaggtccgtgacgtgccagcccgagggcggggacacgtatttggatagagccagatcgccgatctccacgaaaggcatgggccgattaatgcccgtgcccggggcggccacggcgaaacgcggctcggggtaacgccaggcgaatgtccacaggacgcgcaagagtgcattggagctggccgaggccccggagagctgcacctcgccgccggtgcgggccagatagtcgggcaactcggccaggggcacgggggagaaaagcagcacgctctggatggggccggtggccgcccggatgcacaggtccggcaacagcgtgaaggcctcgggccgggccaggtaggcgaaggccgaggccggagcggcgtcgatggttccggcggccagggcggcgttgagctcggagggatgcccggacacgtaggcgatgtcgccgtcctcgggaaaagccggcatgagggcctgatacagcggccagacattgagataggcgatgcggccaagccgcaagggatcgtctgccatgggcactccttttgcgcgccaaaaaacgcggccccgagggtattccccccggggccgtcgtgcaaggcgaattccggtgaactagtcgagctgggacagcagcgtttccttgatggaatcgatggagccggcgccttcgagttcgatgtacttggtcttcccttcgccggccagcttcttgtagaagtaggcggcggccagggtgccggtgttggtgtcgtagtagatgtcatgacgcttgttgatggcgtcctcgtcctggtcgtcggaacgggtcttgaggtcgccgccgcacacccggcacttgtcgccgttgggcttgatggcgtcgatgaagatgttgttggggtggttgggatcgttggcgcacaggcgacggcccatgatgcgatccttggcgatctggcggtcaagcaggatctcgatgacgtaatcgagcttcatgccttccttctgcagggcttcccacagcttctcggcctggaccatgttgcgggggaagccgtcgagcagccagccattgccgcccttggccttgagggtctccaggatcatggggatggtgatctcgtcggggaccagctcgcccttgtcgatgtagcccttggctttcatgccgagttcggtgccgccgccgatgtgctcgcggaagatagccccggactcgatgtgggccagattgtacttctttttcaccagggaaccctgggtgcccttgccgctgccgttgggaccaaaagtgagaatattcaccgggactgcctccatgtttgatttttcacaatcggcctcattacccccgccgccaagccctgtcaatggcgtttccggttttgggggggcggaccggacagcacgtcccggccaaagaccagcccctcccgggccacccggaccgttttgccgcccggaaactggaacacgcggccggtgtcgcgccgcgcgtaagctgcttccagggcggccagaccatcggccagggcctggcccggccccagggcgtccagggcgcgggcgtacagacgcgtccgcagggtcggatgcaggcctgaaaggagcgtgcgggacaggcggaccgtgccgccctcgtccgggacggtgacgggcaggacctcatcgaaataggcggcgtccaggcgggcttgccgccacagccgggcggccgcgtccagggctcgaggattttcttgcagcaccaggggcagcagtccatggcgtacccggttgcgaaggtaggccggatcggcgttggacgggtcgtccatggtcggcaggcccagggcggccgtgaactccgtgacggcgcttcggggcgtgagcagcagcggccgcagcagccggcgggccgggtccagggccgccatgccgcccagggccggccaccccgcgccgcgcgtgacgcgcatgagctggtcctcggccagatcgttgagctgatggccggtgagcacccaggcgttgtcccggccggccaggcaatcggcgaaaaaggcctgccgggcctggcggccggcgtcctcgacgccggtgcggcgctcccgggccatggcggccacgtcggcccggtcagacagacagcccaggccgagtttgcgacaaagcgcccccacggcctcggcctcggtcccggattcgggccgcagcccatggtcgaggtgggcggccagaagtccggccagacccaggcgttcccgcaggatggcggccatggccagcagggcaacggaatccgggccgccggagcaggccacgatccaggtcgccccggccggctcgtgtccgcatgggccggtaacaaaggaggccacacccaggcaaagccgggccaggcggtagggtagggcgctcaggggcggcaggccggggccggttggggaaaggtgtttcgaagggggcgtcggcatggcgggccttgctgcggcggtggagctgatccgggccggcgggcgcggtggcatttcgcggcgaacgcttcgtcggcgttgctgcgggacacgagccttggtgcgttggcaaaaaaccgcttgttgcgaagaagacttctggttccaggttgccgttgcggctaacggcatctcggtatttgcgaaaggcgctgccgggccggacaaggggcatcccgggcgcggccgggacgcccatgatgcgcaatgctgcggtgcggcgtccgattagatcggaatatcgagttcgcggatgaaagtgtccaggaaatcgatcatttgctgccgttgctccggggtgcagtagctgatgcaggaacagcgcagcttcccacgtccgcgcacgagcagctccagcttgagccagttgcgtccggtttccagcacgagcatgtaggggccgcactcgccgtagtgctgctgctgctcgtcgttgagcatctcctggggaaaggggatgtagtagatgtggtccagaggacccttgaagcctttttccgtcaggtgctgctcgatccgctccatgttctcggcggacacttcgtcgatcagataggatcgcatgggttactcgcttgcatcggtcacgtcgaaatcgtcggacgtctccgcgaaattcggcggtttgcggtccgcgtgcgcgtccgttgggactttctcgcggtccagattatacatgcgccgggtgaggtccacgaaccgctcgccgtgctcctccttggcccgccgcttgagaaaggcgatgggctcgtggagcatcttgcggctgatggacagggccatggtttccagggcggcccgggtttcctcgggcacctccggccccagtcgccgcaaggtcttttgcagctcctggcgggccagggaggcgccgacgtccagcaggtccacgatggtgggtttcacgtccagcgatttcacccattcgccgaaacgctccacctgaaggccgatgatgtccctcgcccgggcggcctcctcccggcgctgggccaggttttcctccaccacttcctgcaggtcgtcgatgtcgtaaagatagacgttgtctaagctgttgatgtccggatcgatgtcgcgaggcaccgcgatatcgataaaaaacatcggcttgtggcgtctggccttgagcacggcccgcacgtccttggcccttatgaccacatggggcgctccggtggaactgatgacgatgtccacctcgtgcaggcgcgagacaaactcctcaaaggccacggcccggcctttgaagcgcccggccagttcctcggcccgggcataggtgcggttggcgaccaagatttccgacaccccggaggtgagcagatgcatggcggccagctcggccatctcgccggccccgaccagcatggctttcttgccggccatctcgccgaagatgcgcttggccagttccacggcggcgtagctgatggacacggcgctggccccgatgccggtggccgtgcgcacctttttggccacggaaaaggccttgtggcacagccggttgatgatgaccccggcggtgcggctggccacggcgtggcggtaagctgccttgagctgcccgagtatttgcggttcgccaagcaccagggaatcaagtcccgaggccacgcaaaacaggtggtccacggcggccatgccctggtgggcatacagatgcggggccagaagggccgggtcctggccgcactggccggcccaggccgccagcaccgccgcctttggatcgcgccccacgggatcaaccaccagcacttccacccggttgcaggtggaaaggaccagggcctcgcgcacgcgggcttcgccgtcaaccaaaagctcgccgagtttcggccgctcgcccaaggcgaacgcttcccgaacctccactccggcggtcttatggttgaggccaaacaggtaaatctgctgctccatcgatatatcgcgcaaagctgtggtgtgtgggcatgaagaaattgatgaccagcatggacacaagggtaagaccgaacagccagatggccatacgggcgggcttgcgcccctgccagcccagcaccagacgctggtggaacaggaaggcaaagagcagccagatgcagatagctgtcacttccttgggatcataggagaaaatgcggttccaggtgagcttggcccacacgaagccggacagcagtcccagggtgtagaggggaaaaccggcggccaccgcccaccgattgaccgtatcgcaggtggaaagggccggcagggccttggcgaacccgccgagcttctccttggtcttgatcttgcgttccagatacaaataggccgccccggccccgcaggccatggccagcaggctgatggccaggaaaagcgaaccgatatgcagcccgaaaaagagcccgcccaaagccttgggcaagggcacccgggccgcagtcacggcctgggaggacagaaacaggaacaaggccaacggcgaggccagaagcccgagcatccccaggcgaagccgccaccagagaaagaggcaaatggccagggcgctccaggccagcagattgaaatagaattccccggacaaaaaggccatgccgccctcgatgcccaggagcatgacgagatccagggtgtggcaggcaaaaccgataagggtcagccagcgtccggcccgccgcaacggctgcctggccgtgaccacgcccaggagataggccgccgcgccgagcaggtagccggccacgaccagcaggaaaacgatgttaagcgccggcatgggcaagggctcccgcaacaagtccggccgcctcgccgtggagcgtggcgggcaagatgtcccggaggatggtttcggcccgggcggtgtcggcctgttccagggcttcgagcaggggggagttgaccagctcccggaaaagcgtggaattggccggcgatcccagtcccagccccagcaccaagggccgcagccggctcatgaggatgagcagcgcgccgtattccgagccgagaaactcgcccaggccttggcggatcttgcgggccagggccggtgatgcgccgcccgtggagatggccacggtcaggtcgccctgggtaaacagcgccggcacgatgaagctgcatttttccggctgatcgacgatgttgcagggaatgccgcgctcggcgcactcccggctgatgcgccagttgagcgcctcgtcgtcggtggaggcaatgaccaggaaccggccgtccaggtccgtcgtctcatagggccggcaggcgaagaccacggccggatgcgacaaaagctcggcgcaggcctcggccgcagccaagtcgatgacgaggatttcctcggcgccgcactcggccagggtggcgatcttgcgccgcccgacctgacccgcgcccaccaccaggcagcgcttgccgcgcagattgacgtaaatgggataataccgcatggaaggctcctatagcagaagaacgctcggaccgaaaagggctttttttcacatgaatccttcggattcgtgaccacacggcgaaacgaccatggcgcgatttctcgtcttgcaactggcccgtctgggcgacctgctccagacccggcggcttctggccggcctttttgcccggatcggagcggatggcgggggcggcgaggtccacctggccgtggacgcctccctggccgccctggccggccggctctacccctatgcccgggtccatgccctgccggcccatgccggtcccgggcgcgatccagccgccgtggccctggccgtgcgccagacctgcggcgagctttcggccatccccttcgacaaggttttttgcctcaatttctcgccccttggcatggcgatttcggcgctcttcccgcccgaggtccagcgcggctaccgccagttttccggccagcccgacaaggaccggcttttgcggctggtgtttcgcctgacccgcgagcgccgggcggccggactcaacctggccgacatctgggctcaccttgatgacgttcccctggccgccgccctggtcaacccgccggccgcgccgcgcgggggcgggcttggcgtggccctggccggccgcatggcccggcgctccctgccgccggagatcctggcccccatcgtgcgcacggcgtttcgggccagcggggcgacgcggctgaccctgcttggcactaccgcccaggcctccgaagccagggcgctcgtcaaacagctcgacccagccacggcctcggcctgccaggacctgaccggccggaccggccttggcgaactcagcgaggtgatcgcaggcctggaccggctgctcacgcccgacaccggggccatgcacctggctgcctttcacggcgtgccggtgacggcctttttcctgtcctcggcctggtgccacgagaccggcccttatggcgtgggccacgaggtctggcagtcggtggttccctgcgcgccctgcctggagtcggtcccctgcgacaagggccatgtctgccggctgccctttgccgatcccgccttgttgcggctgctcggcggttcggccaaggtagagccgccggccgggttggcgcttttttgcaccgactgcgacggcctgggggcagtttgccgcctggagcgtggcgaggacccttccgaggcgggccgccgggcctttcgggcctttgccgcccgccatctggccgggcaggacgcggccctggccgacgggacgcccgaggcggccttggcggaacgcctttttctggaaacggactggacgctgcccccgcccgggcgggacgcggccggagaggagtaggggctatggctggtcacggcgtgctgcggattctggtcgtgctgcccatgtacggcggctcgctgccggtggggcggttttgcctgtcggccctgcgcgagcttggccatgtggccgaagcctttgaggccccggatttttacggcgcgttttccgctctcaaggacctgcgagtcacggccgaccgcttggaatatctggaaaacagcttcctgcagatagtctcccaagccatctgcgccaaggtcgagaccttcgagcctgatctggtcctggccctggcccaggccccgctgtcgcgacaagccttaaagcgcctgcgccgcgacggggtgaaaacggccatgtggttcgtggaggactttcgcctcttcacctactgggaagcctttgccccgtactacgacgccttcgcggtcatccagaaggagcctttccccgaacgcctggccgccgtgggccaagaaaacgtgctctatctgcccatggccgccgatccggccgtgcaccggcccctggatttgtcggccgtggagcggcgtacattcggcgcgggcgtttcgtttatgggcgcgggctatcccaaccgtcggctggcgtttgcggagctgctcgacttcgatctcggcatcttcggcagcgactgggacggcgacccggccctgtcggacagggtgcgcctcggagggcggcgtgtcgccaccgaggagtcggtcaagattttcaacgccgccacggtcaacctcaatctgcactccagcatcaacccgcgcgaactggtgccgaccggggatttcgtcaatccgcgcaccttcgagctggccctgtgcggggcttttcagctcgtcagcgaccgtacgctcctgccggaactcttcgccgaggacgagttggcccgtttttcaaccatgggggagcttcgggaaaagctgacctattaccttaataggcccgaggagcgcgccgccttagcaaggcggggccggacccgggctctggccgagcacacctatgccatgcgcatggaatatctgctgggattcgtggccgagcgctttcccggttggccggccggacgagcgggcgccgaggcagccctggccgtgcttcccgaaccgttacgcggcgagacggcgacactgcttggcgaactgtcgctgccggccgacgtgggctttgccgatctcatcgccgccgtgcgcttgcgccaggggcgactgacgtcgctggagacgtcgctgctgtttctggacgagtggaagcgccagtacggcggctaggggcgtgctgtcacgcttcgccgccggaaaaggcaaggcgggcggcttgtcggccgtgccgcggtcgtttccgggtgttgtgcgcctgacggtttctgactaagcctcgccggcccgccggccgcgccctccttgccgcccggcgtgaggccgggccgagcccgaacctacttcttgatctgcaaggccgtctccatgagggactcggccgtggtcaccaccttggagttggcctggaaggcccgttggttgatgatgaggttgaccatctccgaggccatgtccacgttggaggactccagggtgttgccggcaatgctgtcaaagaccccggaattggcccggccgacggtggccttgccggattcggtcgtgggcgagaggaggttgttgccgttgcggtaaaggtcggtggggttggtgaagtcggccagggccaggacgtaaagggccttggtctggccattggtgaagcttccccatatcacgccgttttcatccacgttggtggccgtcatctcgcccttggcgtagccgtcctgggatgatgtctgggtataggacgaggtggcgtagttggtggtgcagtagaccgcgttgagggttgaagaagggttgtagccaatgttgagggcggcgtttgtgccgatggcgccggcattggcggcgctgcctgaattccagctgccgtcggtggcggacagtccggtcttgaaggcaatggtctgggagggcagggctgagccgttggaggcggacttgaacgtggccgaaaattccggcacgcccgaggacgtcaggctggcctgggtccagttggacaggctcgtggggtcgctgccgtttggcgtgaacgcggtttggttttccagcacgccctgggcggagaaggtcagggtgccaaccatgagcacgccggccttggtcgtgcctgaggttgtggcgctgccgtcctcttcgggaggaacagtcaccatgtattcccagtactccttgccggaattgtcgctggtcttggagtagtagaccgtggccgtgtgggccacgccattcgaatcgtaaatcttgatggtcgcctgatagtcggagtcggccacgggcgtgtcgttggtggcgtcgtagttcttgaacatggtgaaatacgggtcggtggcgtcgagttctccgacgctgctttggctgtcgagattggttacgacctccatggtccccgtagcttgcggatctatagtaaagtctttgatggtaatgtcggtaacggtgcccgttgttggcacttccgataaaataacgttgttgcgcttggccttgagaatggcgtcctggtccacggcccagccctggacattgcagccggtggcggacatgaggttgccgttcttgtcgaaattgaagtcgccggcccgggtataataggtcttgtcgttggcggcgtccttgacgacgaaatagccacgctcgccggtaatggcgaggtcggtggaattgctggcgtcttgaaggctgccgacctctgtctgcaacgcgatggagccgacctggacgccggtgccgatctggctgccgtcggacgtgccgccggccatggtgctgatcatgtcggcaaaaagcatccgcgaggacttgtagcccacggtattgacgttggccaggttgttgccagtggtggcgatgccctggctgtaggtgagcagtccgctcactccggtccatatcgagctcatagtcgtccttccttgctgccgcggcggcaggaattgccggtcaggtccggggcgcatgtcgagggttggcctatcggggatgccgataaggccggccatagccgtgtggtccctcgtctcaagtccggcaaggggcaaaccttgccgcttgccggcggaagttgcacatgctgggccaatggatgaggggccttttttgtcgaatgggtaaaaggcagttgacaatcaggccgcggggcgagtaattctgaaagtccgcgctgcgggaaaccgcgccgggcccgaccagggggcgtaagaaacctgggcgggagtgaaaaaaagcgttgacgggccgggcgggcgagcgtagacacgctcctccgcgccaacggaaaccggcgacgcggaccgagggacaacggtgcttcgggttgagtgaaaaaaagtgttgacgggccgcgcggggatgcgtaaaagcttcctccgcgctgcgaaaaacggcaacgcggccggatcgccaaacgggcgaaacggtgattgaaaaaaagtgcttgacgggccggacggggcagcgtagatacgccctccgcttcgggaaaccggaaagcggctgccgacaaacgagtcggcgggttttgaaaaaaagtgcttgacgcgggaatgtgggcagcgtaggttgccgcttcctgttgaccgccggcaacggcgggcgaagcaacgcggtctttgacaattaaatagcgagttgggtgatttctgtaagccatgcttaagatgcggcaacgcatacttaggtttcagctaataaggatttaaactggagagtttgatcctggctcagattgaacgctggcggcgtgcttaacacatgcaagtcgtgcgagaaaggggacttcggtccctgagtagagcggcgcacgggtgagtaacgcgtggattatctacccagatattcgggataacggcgggaaactgccgctaataccggatacgctccaatttcggttgggggaaaggcggcctctgcttgcaagctgtcgtatctggatgagtccgcgtcccattagcttgttggcggggtaatggcccaccaaggctacgatgggtagctggtctgagaggatgatcagccacactggaactgaaacacggtccagactcctacgggaggcagcagtggggaatattgcgcaatgggggaaaccctgacgcagcgacgccgtgtgagggaagaaggctttcgggtcgtaaacctctgtcgggagggaagaaccttccaggtctgaataagccctggaactgacggtacctccaaaggaagcaccggctaactccgtgccagcagccgcggtaatacggagggtgcaagcgttaatcggaatcactgggcgtaaagcgcgcgtaggccgccttttaagtcggacgtgaaagccctcggctcaaccgaggaactgcgttcgaaactgggaggcttgagtcctggagagggtggcggaattccgggtgtaggagtgaaatccgtagatatccggaggaacaccggtggcgaaggcggccacctggacaggtactgacgctgaggcgcgaaagcgtggggagcaaacaggattagataccctggtagtccacgctgtaaacgatggatgctaggtgtcggggagcgatcttcggtgccgcagttaacgcattaagcatcccgcctggggagtacggtcgcaaggctgaaactcaaaggaattgacgggggcccgcacaagcggtggagtatgtggtttaattcgatgcaacgcgaagaaccttacctgggtttgacatcccgcgaatcctcccgaaaaggaggagtgcccttcggggagcgcggtgacaggtgctgcatggctgtcgtcagctcgtgccgtgaggtgttgggttaagtcccgcaacgagcgcaacccttgtctttagttgccagcgagtaatgtcgggcactctagagagaccgcctcggtcaacggggaggaaggtggggacgacgtcaagtcatcatggcccttacgcccagggctacacacgtactacaatggtgggtacaatgggctgcgagaccgcaaggtggagccaatcccaaaaaacccatcccagtccggatcggggtctgcaactcgaccccgtgaagtcggaatcgctagtaatcggagatcagcatgctccggtgaatacgttcccgggccttgtacacaccgcccgtcacaccacgaaagttggttctacccgaaagctccgggctaaccgcaaggaggcaggagtctacggtagggccgatgattggggtgaagtcgtaacaaggtagccgtaggggaacctgcggctggatcacctccttttatggatacgaaaacccaactcgctatttaattgcaaggaccacgcgtctttgcaagttgcgcacacgatgggcctgtagctcaggtggctagagcgcacgcctgataagcgtgaggtcgaaggttcaagtccttccaggcccaccatgcttaccgggggtgtagctcagctgggagagcgcctgccttgcacgcaggaggccatcggttcgatcccgttcacctccaccattggatgtgaaacgggtgcgcgacactgatctttgacagttaaataagggatgggatttaggcaaaagccaagtaattaagggcaatcggtggatgccttggcgctgagaggcgatgaaggacgcggtaggcggcgatacgcaccggggagcagccaaacgtgctttgatccggtgatttccgaatggggaaacccagcaggagtcatgtcctgttatcccttgaccgaatacataggtcttgggaggcgaacgcggggaagtgaaacatctcagtacccgcaggagaagaaatcaaaagagattcccgtagtagcggcgagcgaaccgggaagagcccaaaccaggcgtctccggacgtctggggttgtagggcctccatcaagcgattcatcattaggcaggggaagcgtctgggaaggcgcgccatagagggtgaaagccccgtacctgaaaccgaacgtgacgctggaggtacctgagtaccacgagacacgcgaaatctcgtgggaatccgggaggaccatcttccaaggctaaatactcctcagcgaccgatagtgtaccagtaccgtgagggaaaggtgaaaagaacccctgtgaggggagtgaaacgagaacctgaaaccgattgcctacaagcggttcgagccggacttgtccggtgagagcgtgccttttgcataatgagccagcgagttatcctgtcgtgcgaggttaaggctaaaatgccggagccgtagcgaaagcgagtctgaatagggcgaacagtacggcgggatagacccgaaaccgggtgatctatccatgagcaggttgaagctcgggtaaaaccgagtggaggaccgaacccatatgggctgaaaaccattgggatgacttgtggataggggtgaaaggccaatcaaactcggtgatagctggttctccccgaaatatattgaggtatagcctcgggaaggaaggacggaggtagagcactgaaagggctaggggtctcaccagattaccaaaccctatcaaactccgaatgccgttcttttatttcccgggagtcagactctgggtgcgaaggtccagggtcgagagggtaagagcccagatcgacggctaaggttcccaaatccatgctcagtgggaaaggaagtgggaccgctctgacagccaggaggttggcttagaagcagccatcctttaaagaaagcgtaatagctcactggtctagtggtcctgcgccgaaaatgtaacggagctaagcatggtaccgaagcctcgggcctatcttaacgataggcggtaggggagcgttcccggacgggatgaaggcagattgtaaagtctgctggactaacgggaagtgataatgctggcataagtaacgataaaacgggtgtgaaacccgttcgccgtaagcccaaggtttcctgggtaaagttaatcttcccagggtgagtcggtccctaaggcgaggccgaaaggcgtagctgatggaaaacaggttaatattcctgtacctgtttgtgtgtgcgacggagggacgcaggagggtaggtcagccggctgttggaagtgccggtgcaagcgtgtaggcttggagaacaggcaaatccgttctccttcaaggccgagacgtgatgccgtgtcttacgactgaagtgactaatcccaggctgccgagaaaagcttctaagtttagcacaagcagaccgtaccgcaaaccaactcaggtgggcggggagagtatcccaaggcgcttgagagaactctggttaaggaactcggcaaaatgaccccgtaacttcgggataaggggtgccccctatggtgaagcatttactgcataagccgcggggggtcgcagtgaaacggtggtggcgactgtttactaaaaacacaggtctgtgcgaagtcgtaagacgacgtatacggactgacgcctgcccggtgccggaaggttaaggggtggagtcagcgcaagcgaagctctaaaccgaagccccggtaaacggcggccgtaactataacggtcctaaggtagcgaaattccttgtcgggtaagttccgacctgcacgaatggcgtaacgatctccacgctgtctcgaccagagactcagtgaaattgatgtggcggtgaaaatgccgtctacccgcggaaagacggaaagaccctgtgcacctttactatagcttgacattggagcttgggcaaccgtgtgtaggataggtgggaggctgtgaaaccggcgcgccagcgtcggcggagccatccttgaaataccaccctcggttgtttaagcttctaactcggaccgttatccggttcgaggacattgtctggcgggtagtttgactggggcggtcgcctcccaaagagtaacggaggcatgcaaaggttccctcaggctgattggaaaccagccgtcgagtgcaaaggcataagggagcttgactgcgagagagacatctcgaccaggcacgaaagtgggccttagtgatccggtggtcccgaatggaagggccatcgctcaatggataaaaggtacgccggggataacaggctgatcgcatccaagagttcatatcgacgatgcggtttggcacctcgatgtcggctcatcacatcctggggctggagcaggtcccaagggttcggctgttcgccgattaaagtggtacgcgagctgggtttaaaacgtcgtgagacagtttggtccctatcttccgtgggcgttggagaattgagaggggttgtccctagtacgagaggaccgggatgaacgaacctctggtgcacctgttgtcgtgccaacggcatcgcagggtagctatgttcggaaaggataaccgctgaaagcatctaagcgggaagcctgcctcaagacgagttctccctgaaggacccatgtagactacatggttgataggccggatgtgcaaaagcagcaatgtttgagcagaccggtactaatagtccgttcgacttgatttttgccaacagacaatcccatcccttattttaacttatatatttgtcctggtggtcatagaggagggggtacacccgaccccattccgaactcggaagttaagccctccttcgccgatgatactgcatattcttgtgtgggaaagtaggtcgccgccagggctacttttcaaaaagcccccgaatcgaaagattcgggggctttttttatggtttccgggccggaaagaggacgggggtaggggagggaccacggtcacggtcactgtaggggacgcggacacggtcggggacacgaccacggatacggacgaggtcaggggataggtttgcttttctgccggccagcaggcaagaggagatgaaagcacggggaagacacttggggcatgtcgctaggcatccagtcagtatccagacataacgatatggactggagtttcatgacgactccgtggttgcccgccattgcagaaaagattcctgcgataaggaggcttcatggaacgcaccgcgaacatgttggacgctgtccccgacctgtggcaggaagcatccgtggccgtctgggcggagccggaatcacgccgtatcgcgtcactcaacttcgatgacgctcaggtagataatgtcgcttcgatctccctcgcggacgcgccccatgcctccttgggcctggacccggtatccctcaaccgatttgtcctgtgcctgctggcggcggactgggcctgctaccctgatccggccaaccgcgaagcttacccgcatctccaacacgcggtcacggtctttcccaaaggctttcgcctttggacggccggcgcaggcggctgtatcctgcctatcggctattcggcctttcaccctatttccccggccaccttcgccgtcctgcgcgacgcgccgcaaaccatcaccaatcgtcgccagatcacaccccagccccagaccgcgtccggtgagcagtacctctatctctataacatcggcatcctgccccggttccatcgcaccgaggcaagccaggcgctcatgcgggcgtttcgcgaagacctggatgccacggcgcatcgcgggcttgccgccatcatcgtctcgcctgacggccagcgtgtcatcgaacggttcggactgcgccaatcaggcgtcatcacccatgacggccacgaagaactggcgtacgtgagcgacgagtaactgctgatcttgtactgtatcccagctcgcccgcattgacagccgtcgccgccgggtatagccggctttcgaaacatttcccggcacgcacggagttcccatgcttggcattcacgatctgtggctttttattgtctcgggcatcctgttcaacatggctcccggcccggacgtcatttacgtcgtcagccgcagcgccggacagggggccaaggccggcatgacagcggccctgggcatcggggccggttgctgcgtgcatatcctggccgccgccgtgggactttcagccgtgctggccgcctcggctacggccttttccgtgatcaaactggtgggcgcggcctatctcgtgtatgctggcgtgcgcatgatccttggcgcgcgaaaaaaaacagcgcccgaggaaattcctcagacgcctgaaatccggcatcgtggcatcttcgtccagggctttctcaccaacgcgctgaaccccaaggtggcgctgtttttcctggccttcctgccccagttcatcgatccggccgcgccgcgcaaggccctggcctttgccgtcttgggcggcatcctcaactgcaccggtacgacctggaatctgctcctggcctggtccacggcgcgcgtcgccggcggccttggccgcgcccggcggcttggcccctatctcacccagggggccggtgccttgttcgtggcctttggcgtcaagctggccctgtccgaacaatcctgatttccgcccccctgcctcaccaaaacgggcttcctgccccatcccgtctgattccgtgccgtttgacgcctgttacgcgttgacggccggatttttcgtcgcgcccgacgccgaaccgaccttgagccggcgtcccgtggcccgcctatacgcccattccaggccgaaagagaccggaaaaagcccgagcatggtccagaaggccggccgggagtgggcgtacatgttggatccaagcacgcccagcagcgacaggcacaaggctatggacagccagatgagcgccggccggccgccggtggcggcgcgcaggcgcaggtgggagcaggccacggcggcgtagataaacaaaaacgcgccgctgcccatcatggccacgctggaaagatcgaaaaacagcacgaaaaccagcaccagcccggcagtcagaaagagcccttcaggcgcgcgtttccaggccgtccggtcaaaggcggccggcagctccccgtccttggcgatcatccagcagacgttggccgcgccgtagagggtggcgtttaacgccgctgccgtggcgaacagcgcgcccacggcgatgacggtgaaaccggacttgcccatgaacgtgccggccgcctcggacagggcgtagtcgctggccgcgtcgatgcgggccaggggcagatggccgagcacggcaaacgctacgccgagatagaccacgatgaccgaaaataccgacagatagagcgccctgggcagggtgcgcggcggatcggccatgtcgcccgcggcgttggcgaccaggccgaagccttcgtaagcgataaagagcatcccgccgccaaaggcgatgcccgagggttcggcccagccggccctggacagcccctgccagtcggcggtggcgcagccccagaccgcgaataccgacagcacggccaggttgacggtcacggtcaccagttccgagcgcccgacccaggccgcgccaaagacgttgaccagggtaaaaaggagcaccgcgccgacggcggcggccttgggcagccagagcgggtgctcgtgggggaaaaaggtcatgaggtagccggcgaaaccggcggcgtacatggccagggcgatgacgtagccgatccacatgtagatgttgagcccgccgctgaccacgccgtcgccaaggccgcgcaccaaaaattccaccgcaccgcccttggtggggtagcacgcgccgagttttgcgtagttgtaggaggtggccagggccaccagcccgccggccaggaaggagagccacagggccgaaccggccacatgggcggccgagccgaagatggcgtagaccccgccgccgaccatgccgccgatgccgatggccacggccgaggccaggctcatctgtttggcggcaggggcggcgggagcgcctttagctgagggagaggaagcggacagcatggaaaggctccgggtagggggtgggcgtggagtgtgacaataagcgttcggcggctggttgctggcggccaaggggccgtgccgtaggggcggtgaaggacgtttgaagctacgacactgggtgtggcggcaagacgttgggaagtcaatggaagagggggggcgaggcgtggccggagtggagccggacatgctccaccttcacccgcgccggcaaaccgcccagtagggagtttgtccttctttgcttagtcctgttcctggatgactgttggtgcttgaagccgaggccgcccaaaccggccggtccgggcttgttgaggccggccaagaggcgtacagagccctgaccggacatcattttgcggagatttgcgtgacgcaacgggtttattactgcgccaaatgcctggggcagcttggcttgctgtggggcatttccctggccggccggtttctggccgagaccctggcgctgcccgtgccgggcaacgtgcttggggtgttgctgcttttcggtttgttgtgcctgggcgtggtcaagctcgaacaggtggcggcgacggcggattttctcctgcgccatctggtcttttttttcatccccatcgccgtgggcctcatggactggggcgcgaccttcgcccagtacggcctgatgctgctcgtggccgtggtgatcagttccgtgctgccgtttttcgcggtgggctatctcagcttgctgctccagcggaggcggtgatggacggacttgcgcttggcgtcgtgtttgtcgttttgacggtcgcggtctatttggcctgtcgccggctggcgttttgggtgaaccatcccttgctcaacgtcgtggcggtcagcgccggggtcatcatcgccgtgctcgtggcctgcgatctgccctacgccgcctatgccccggcccgggaggccatgaccacgctgcttggcccggctacggttgccttggccgtgccgctctaccgccatcgccggctgctgcgcagccatggcctggccatcctggccagcgtcggtgccggggcgctgctcgccatggtttcggccgggctggcggccagcctcggcggcctgccccgggaggtggtggtgtccatcctgcccaagggcgtctccataccttttgccgtggaaattagccgcatatacgatgggataccggcgctcagcgccgcctttgtcgtggccacgggcaccctgggctcgctcttcggcgcctggctgctgaaccgctccggcatcgatcatcccgtggcccgggggctggccctgggcacggtgtcccacgcccagggcacggccacggccctgctcgaaggcgaggagcagggggccatggccggtctggccatgatcctggccggggtcttcaccgccggttttgcaccgctggtggtgcggctgctcggcctgctttagagccgcagtcctcgacaaggccgggtcatcctcggcctggagcacgtagcgcggcgcgctggctcggggccggcacgtcacgcatccagccgcagccgttcgatggttcctgtggccgaggttctcatccagatgacgggcagactagggtttcgcctggacgaggttgttgatcttacaggctgcgcaggccgcgccgaagccgttgtcgatgttgaccaccgtcacgccgctggcgcaggaggtgagcatccctaaaagcgccgcgaccccggaaaaggccgcgccgtagcccaccgacgtcggcaccgcgatgatgggctgggacaaaagcccgccaatgacgctggccaaggccccctccatgcccgccgccacgatgaccacccgggcgcggcggatgtcggacagcttgtccaaaagccggtggatgccggccacgcccacatccgacaccacaaaggcccggctgccaagcatttggcaggtttcacgggcctcctcggccacggccagatcggacgtgccggcggtcacgatggcgatctctccgtccttataggcgatctcgccgcgcgtgagcgtcagggtgcgtcccagggcgttgaagcgcgcttgcgggcacagcccgatcacatgggccgccgtctcgggcgacacccgcgtggccagcacattggcgtgttcgcgcaggcgcaggaaaatctcgcccacctgctccggcgtcttgccctcggcgtagatcacctcgggaaagccgtttctaagcgaccggtgcaggtcgagcttggtgtggcccatgtccagaaagggcaggtcgcgcaggcgcgaaagcccgtcgtccacgctcaggccgccgtcgcggatgtcgtttaaaagcgctcgcagagtctcattcgcgtccatggttccgtatcgctttgcgcccggcgcggcctggtcgataaggccgcgcggcacgggtttcaggtgttgccggcgtcgtgcggaccggttgatggtcggaccggcccgtgccgatatctaagcgtcgccgcagggtggcgggacagacgccgcgtccggcttttcgttgaggctgcccatgcggtagccggccaggtccagggtcacgtggcggtagcccagggccttgagcttggcgtcgatgtcgtgcctggcgtcggcctcaagaacggccggtgcctggtcgcgcggcacttccaggcgggccagatcgccgtggctgcgcagccgcacggccgggaagcccaggctgcgcagccaggtttcggccgtgtcgatacgcttgagctcctcggccgtaacgcgcctgccgtggggcaggcgggtgagcaggcaggccccggacggcttgtcccagatgggcaagccggcctgccgggaaagcgcccggatgtctgccttgccgatgccggcggacaaaagcgggctgacgatgcccaactcggccagggcgcgcagccccgggcgatggtcgcccaggtcgtcctggttggtcccgtccagcacatgggcgatgccctcgccggcggccagctccagcagcttggcaaaaagcgccttcttgcacagatagcagcgctcgggcgggttgtcgcgcagcgcctcgggaaaggggacgggcaggaccacatggcgtacgccaaggcggccagccagggccgccgcctcggcgatctcggcccggggggcgtagggcgtgtccagggtgacggcggttaggccctcgcccatggctcggctggcggcgtggagcagaaagctgctgtccaggccgccggaaaaggccagcacggcagattgcagcccgcccagatcggccagcaggcgacggtaccgctcgattcggccagcgtcgtcggtcacggcgtttccccgcgtccggcgcactgggacaccacggcctggacctcggccagggacagcccgtgacgcctggccagttcccggcagtcctccagttcgggcttggagcgaagtcgtacgccatttcgggcggcgtgcttcatggtcaccggccccaggggcgtgtccaaccgggaaaaggtccggtcgagcacggttttctccaaacgcaggactttgacgccaagcgttgtggtgtggcgaaagaccaagtccttgaagcgttcttcgtcggcggcggcgcagagcagcgacaaggtcgtgccgggccggtttttcttcatgaggatgggcgtgaaatgcacgtccatggccccgtgttccataagcacgtccatggccacgcccagggcctcggcggtcatatcgtcgatgttgcagacaagcagccgggcgtcgtccggggccttggccgccgtggcgtccggggcttcggccttggctaggtggacccgcaggacgtttggccgctcggtgtggcggtggccgatgccgtaggcggttttttcaagggtcagggcgggcgtggcggtgaagcgggtggacagggtcgccaggatggccgcgccggtgggggtggtggcctcgtggggtgtgccgccccgggtggtgggaacgccggccaggatttccgtggtggccggggccggcacgggcatgaggccatgggcgcagtgcacaaaaccgccgccaagctccaccggcgaggcccagaccgcgtccacgcccagggcatgatagcagatggccgctcccacgatgtccacaatggaatcaacggccccgacctcgtggaaatgcacctcgtccaccgccttgccgtggaccttggcctcggcctcggccaccttgcggaagatggccaggctcgtgtcctggaccggttcgcttaaggaacttccccggatgatggcctcaatggcggccaggttgcggtggggggcgtggccgtggctgtgagaaccgtggacgtgctcttgcccaggctcgtggtggtggccgtcgtggctatgacggtggccatggtcgtgggctgccgcgtgggcatgacgcttcgcctgggcttcgtggtgatgcccgccatggacatgaccgtgctcttgctcctggccgtgttcatgatgtctgccgtgcccgtgttcgtggccgtgcggtccgccgtggtcgtgtccatgtatctcgccatgttcgtgatggccgccggccgcgtcgtcggcagttagacgcacgtccacgcgcaggccgtggatgccgtttcgggcgtcctcgccgacgtccagccgaaattcctcatccagaccaagcttggacagttcggcccgcaggaagtcgggcgaaacgccaaggcccatcatggcggccaggttcatgtcgccggatacgcccgcgaaacagtcgtagaacagtattttcatgggatgccgcgccggtgcgccgggttgccgggttcgttacgccgggtcatggttgagcaatggtggggcaatcggcgcggcttgtccagaggggggcgagccgcgccgacgcgggcgggatcagtcgaggccggcccggaagtggtttttgagcgcctccacctcggcttggaagttggggccttcgaaggcggcggcgaccttttccagttggtcggggatggcgatctgctggggacacttctccagacactcgccgcaggccacgcactgggaggcgtagctctgctcgccgtttgaggtcacgccgctgccaaaggcggtgtacatcatcttggccccggagttctcgccaaacatgtgcagctgattaaagaagttgaagcagttcggaatgttgacgcccattgggcagggcaggcagtaggcgcagccagtgcagcccaccggcatgagttcttggtatttgcgggccacccggtccaccagttccagctcggccggggtcagggagccgggggcggccacggcggccacggccaggttctgggcgatatgggcctcgacgttcatgcccgagagcaccaccgtcacctcgggatggttccagatccagcgcagcgcccattccaccggcgtgcgcttggtcgcggcctcgtcccacagggcggccacggccggcggcgcttcgggcagggccagggtgccgccgcgcagcggctccatgatgatcacgcccaggcccttggaggccgcgtactccaggcccgccgtgccggcctggtactcttggtccaggaagttgtactggatctggcagaagacccagtcgtagccgtccacgatgcgggcgaaatccttgccctcgccgtggaaggaaaacccggcgttgacgatgcggccgtcggccttggccgcgtccaggaactcccgcacgccaagggcgaccagttcgtcccaggacgagcctttgagggtgtgcagcagatagtaatcgatgtggtccgtgcccaggcgctccagctgggcgtttaagtaccggtccatgtcctcccgggattggacgagccaggagggcagctttgtggccaccttgacgcgctgccggtagccgtctttgagggccttgccgagcaggggttcgcttgcgccgccgtggtagggccaggccgtgtccacgtagttgacgccctggtcgatggcgctgcggatctggtcgatggctcggggttcgtcgatgacgccgtccacggtcggcatccgcatgcagccgaaaccaagaatggacagttcgtcgccggtcttgggcatttttctgtagagcattgtttctctcctcgtcgcgggcggttggccccggatggttgccgcgtttgtcggcatggtgcgacgagaggcaccttatccgagggcagcgggccgatgaacgtccattcctgctgaaaaattgcctgatcctcgcacgggtgggcgtcgccctcttccgtcgcttccgtcgtgccgtcttagtcgccggccagccggcgcaggcttttgatgtcgcgaagcggcggcgcgccgaaaagccggctgtattcccggttgaactgggaatggctctcgtagccaacagcaaaggccgcgccggcggcgtcgatgcccccggccaagagcagccgccgggcctcgtgcaggcgcagccacttctggtactgcagcggactcatggccgtcagttcccggaaatggcggtggaaggtcgaaacgctcatgcgcgcctgttcggccacctcctcaacccgcagggcttccttgaaatggcccttgagccagtcgatggccacggcgatctggctgccgcgcgagccggccgccgcgatctggcgcagacgcgccccctggtcgccggtcaggagccggaaaaggatctcgcggtacaccagcggggccagcgccgggatgctctcgggttcgtccaaaagcgccaccagccgttgcagggcgtccagaagcggcagggtgacccggcccacggccatggcccggttggtctgccgctcgggcaggggcggcggcttgctgtccaccaccgtctgggccacttcgcgctgatcaaggcgcagcaccaggccgagatagggcgtctcgggactggcctcgacgatctgggacatcaccggcaagtccaccgaggtgatgagatagttgtacggatcgtactggtagacgtcctcgcccaggtacacccgcttggccccctggacgatgcagcacaggctcggctcgtgcacgtagcaggtctgggccgtgggctcgccgcgccgcaccagggtcagggccgggatggccgtgtccagcacgtcgcaaacggcggtgcgccgggcgatgctttcggccagcccctcgcgggcgaccttgatgtcttcgggttcgacccggcgggaagcgccctgatcggtcattggacaccgtccttgctgttttggccaaggttacccgggtccggcccggcggcaaggctgtttgatcgtttttgcgaggattaggcaagaaagcggcacgatcaaacaatgcgttttcttctttttcggtctggcgcttcgctgtcccggcgcggaccggactgtttcttggccgtgggcaagggaggagcgccagagttttgttgacaatgacaatcgtaatcaattatggctccccaagcctggaacggacgctttgcgggacaaggccgacgaatcgacaggtcgcgggagtggggcggacaatggcgagtcaggacgacgaaagtttgcgcgaggcgcgggccagactggagcaggccggggacgacccggccgaggctttggccctggccgccgattttctgcttttggccgagcgcatggccggcaaggccgagaagctggcccgcatcggcgaccgcacccaggcccgcatggtggacctcaaccgccgcctgcgccagcaggaagagcgctaccggggcattttcgagaattccaccgaaggcatctttttggccgacgccgagggcgcgctcatggccgtcaatcctgccctggtcggcctgttgcgaccgggcgaggtggccgacgatccggccacagccacgccggccctggccggtgacgtccaatccttgttccatgatccgaccgactatcaggcctttgcccaaaaactggcggcaaggggccaggtgcggcgcatggaggcccggctggccaccccgcgcgggccggtctggtgtctggtgggcgcggccctggtcgagcccgacggccatgtggtcggcatgacccaggacatctcggcccgaaaggccctggaagaggagctattgcgcctggccgcctcggacccgctgaccggcctggccaaccgccggggctttttcgagggcgcggcccggatgctcggcatggcccggcgctgcggcacgccgctgtccatgatcatgctcgacatcgaccatttcaaggccgtcaacgacgcctatggccacgacgccggggacgccgtgctgcgggccgtggccggaaggttgcgcgaaagccttcgtgtgtccgatctggccggccgggtgggcggcgaggagttcgccgtcctgtgcccgggcacggacctggccggcggcgtcgaactggccgagcgcctgcgtctggccttggaggacatggtagtgacggccgattgccgcgccgtcaaggtgacggccagttttggcgtggcccagtgccgcgatgatcgtgacgccgcgccaagcgcctgcctgacccgggccgaccgggcgctgtacgccgccaagcgcggcggccgcaaccgggtttgcctggagtccgacggttcccttggccccggggccgtgtgatgcttctctcaaaacatgacgcaggcatgttttcaggatgtcgcaaaatctggcggtgttgtttgttgtggtggtggccttggcatacgtaaagccggtatacggcgcttgggccgtcccgtgcggtgagacggagtgcgacaacctgtggccggagccttgcggcgcgaaaatcctcaaagccgtcgcaatgttgccatttaatgatattgacatcaattttcaatttcaataaagaggctcaggcaaaggggtgatccagaacactggaaggccgcaacggcaaggaggccatggtgcgcagattcattcgaaaatggcggggcggggaggccggggaaggcgtcatgaaagcgggcctgggcacgccggccaagcttggtctgatcctctttcctttcgtggttgtcgctcccttgggcctcatgttcggccacgccgccctggacgaggccacgctcaaggccgtgctggccggctacgtcaccctgggcgtgatcctctattaccccctggtgcgcctggccgggaaatccattgttttcgatcaggtcggccggctggtggacagctgcatgcgcatcaagcagggctgctacgacaccgccacggccccgccggcccggggcgagtccggtgattttccgggtctggcccggcaaatctactggcttggccatgccgtggccgtgcgcgagcgacgcttaaacgacaccctggtgaacctggagacggcgcgccgccagatcgaatcgagcatcgactacgccgcccgcatccagcgcgcctttttgtccgatccggccgaactggcctcggtgtttcccgacagcttcgtgtggtgggaccagcgcgacgtggtcggcggcgacgtctttttcctggccaaaagcgccggcggcgtctttctcggcatcggcgactgcaccggccatggcgtgcctggcgcgttcatgacgcttatcgccaaggccgccctggaccgggtgcgcctggaacgcttcgagggcgatccgggcggcgttctggccgaggcccaccgctacatgcgccgctggctcatcgccgagggcggcgaggtggacgacggcatggatatgggactggtttatttcgacgccgacgacgcctcgcggctggtctacgccggggcgcgccggccgctttgggtcgagcgcggcggcgaggtcgaggagatcggcgcggaccgcctgggcctgggctacgccaaaaccccggaggacgcggtctttgccaacgtggccgtggagttggctgcgggcgatacgctctttcttttttccgatggcctcaccgaccagatcggcggcgtacggggcttgccgctgggcaaaaagccccttcgccaatggctggccgaggcggccggcgcgcccctggtagagcgtcggcaggccctggtcaccatttttgaaaaccacaggggccgcgcctcccggcgcgacgacgtggccgccctggccgtgcgccccgttgccaagcaaggagtcaatgcatgacaggcgggccgcaattcgacaaatgccgggaaatgctgcgcgagggcggcgtggtcctctacttcaagggaccggtgacccaggaggtggtggagggccttggctccatgatccggcgcaaggtggatttcgagatcgccaaccgttcccgggcctcccaggctttcgccgtgctggtggaacagctgcaaaacgtgctgcgctacgccgccgacgccgtggacatggccagcggccgcatggcttccggggaactcatcatccgcctggacccggccggcctgtgcctgagctgcggcaacctcatcaccagggacctggggccgcgcatccgggaacgcctcgacgccctggccggcgttgacaaggacggcctcaaggccctgtacaaggccgcccgccagcaggggccggacgagcagtcgcgcggcgcgggactggggtttctggagatggcccggcgggccgtttcgcccatgcgctacgagatcgaggccgtttccgacgagctggcctggttttccctggatgtcgtcatcgcctaaaagcgttcttcaaacagacgctcgtgttattgtaaaatcatgagttgcaggtggttgtcggcgaagtgccggatgctctttttaaggacgcgacacgagccgggaagaccgccgccattgcagccgccgcgcaaggtccggcctggaagcgttttcagggccgggaccggcgcaggccataggagagaagttttcatgcagccgtttgtctgcgcgcccacgcgctccacgccggaagtccactttgacgcggccagccatcgccaccgcatgaagggcgaatgttatccggaaaacgcggccgcgtttttcgggccgcttttcacctgggtcaaggcctatctggccgccaaaccggccggcccggtcgtgttcgatctggaactggtctatttcaactcgtcctcgtccaaggctctgctcgacctcttcgagatcctggagcgcgccgccgcctcgggcacgaacatcaccgtcaattggcgctacgacaaggataacgacatcgcctgcgaatgcggcgaagagttcgccgaggacgccaaggcgctcatatttacgctgctggcgctctaacaagagggagatgcctccggcggccgggagggggtaaccccctcccggaccctccctgaaaggggggcaacaaggatcaaggagcgaggggggacgacatggatgacgtcgccatggtggcggatgggccggaaacggttcggaaaatggcggccggccggccgctttgctggcgcgcgccccatccggcctccctggccctggccggtcttgtggccgtggcggccgggggtgcggccggggcctgcgtcctgtggcagatgccgccggttgctgccgttttgttggtcgggctttcggccctgtgcctgaccctggccggcctggctttgctggcggaaatgccggcgcgcctcatggccgaccggctggcccaggcggcggagggcattcaagccgaggggccgccgcctctggcgcttgtcgtcggccctctggccgggttgtggccggcggccggtgaggtggccgggcgggtggccgaccttggggccgaagccgaggctcagcgccgccaggccttcaccgaaaatcgccaggcgctcaaagccctgcgcgacgcgaccaaggcccgcaagcaggccgaccaggcgcgcgccgccgccgtggccgaggtggtgggcgaggtgcgcggccatgtggacgccgcctcgggtcggacccggtcgctgctggccgatagttccgccgccgtggagctcgtggccggccagtcggccagcctcggcgaggccatggacctcctcgacctggccctggccgccgtgcgtcgggcctccgatgccgccctggccgccgccgccaaggccaacgccgccgccgccacagccgccagcggccgccgcctggaagaggggctggggcaggggtgccgcaccttgtccgcggccatggacgggctttcaacctccttttccgaactccttggcggcttgcgctttgccgccgacaccggcgaagccattgccgacatcgccgaccagaccaacatgctggcgcttaatgccgccatcgaggccgcccgggccggcgaccacggccggggattcgccgtggtcgccgacgaggtgcgccggctggccgagcgctccaaggaggccgccgcccaggctgccgcccggttgggccgggttctggcccaggccgagggcaacgccggccttttgaccgaagccaacgccgccgccggcgagttcctcgacctgtccggccggctaggcgcggccctggcctccatcgccggcgacgccgaggccgcccggacccaggggcaaggcagcgccgaggccattgggcagtccctggcttccttggaccgggccggtcaggccctggccgaaaccctggccaaggccacggccatcgaagaatcgtccctggccggccaggaccatgcccgccgggtggaagaagccctggccggcgtggacagcctcatggcccggctatgcggcacgacggcggcggacggatctgtggcctgtaattgaaaattacagccattatcaatgaatccgaaatccagtcttggttgggagggaatatggacaggcgcgaggacgacaaccgcacgcatctgggggccattgccccgggcgggcaatgcacggtggcacgggtgggctgcgacggctgcctggggcaacgcctgggtgatctggggctggtgccgggcgaaacggtgacggtggtgcgaaacgcgccccttcgcgaccccattgagatcaaggtcagcggctttctggtcagcctgcggcgttgcgaggcctccctggtcgaggtgacggcaaaatgagcgcgcgcatcctcgccgccctggccggccagcccaactgcggcaagtccacggtctttaacatgctcaccggcgcgcgccagcatgtggccaattttcccggcgtcaccgtggaaaagaaatccggccatttcaagctcggcggcagcagttgcgaactggtggacctgcccggcgcctattccatcagctcctattccccggaagaacgcgtcacccgcgatttcctgctgtttgaccaccccaaggtggtggtcaacgtcatcgacgcctccaatttgcgccgccatctgtgcctgaccgtggaactgctcgagcttgaggccaacgtggtggtccattgcaacatgatggacgtggccgagcgccggggccagaagcttgacatcgaggccttggccgcgcgcctgggcgtgccggtgtcctcgggcgtggggcgcaaaggccagggccgcgagaaactggcggcggtcatgacccaggccatggaacagccccccaaggacgagccgtttcgggtggattacggccccctggaaccccacatccgggccgttgaggacgtgctggccgagggcggggagctgggcgcgcccaggcgctggctggccgtgcggctgctggagggcgacgccggagccacggcgttcgtgggcgaggtgtttttcgatcccgtgcgcctgggaacgcttgtcgccgagcgccagcaggcctttggggaggcgtccggggaatcccccgccgcctttgccgctctggcccgccgccggttggccagaaacctggcccaggccgccacgctcaaggccgccggccccgagcgcaccgccacagaccgcatcgacgaccttgtgtgccacaaatttcttggtccagccattctcgtggccgtgctgttcgttctctaccaagtgtccatcgtctacggctacaagctcaccaactacacctggccgcttctggcgggcctcaaaaacttcgtggccggctatctgcctccgtccggcatgctcgaagacccggtgctgcggtcgctcgggctgtggttcatggattccatcaatgcgctgctcaactacatcccgatatttttcctgctctttttctgcgtggccttcctggaggacaccggatacatgccgcgcatggccttcatcctggaccggctcttccggtcctacggcctgcacgggcaatcaaccctgcccatggtgctggccggggtctatctcggcggctgctgcgtgcccggggtcatggcctgcaaggccatcccggacgacaagtcccggctggccaccatccttattatcccgctcatgaactgtctggccaaggtgccgctctatgtcctcttggtcggcgcgtttttcccccacgaagcctcggcggccatgttcttcatctccacggtaacgctgttcatggccctgcccatcgcccggctgctctcgggcacgctgctgtccaacctcgacagcgcgccgtttatcatggaaatgccgccataccatatgccgaccctgcgaaacctcctcaccagggccattgagaaggtggcgcttttcattcagaaaatcgtcaccgtggtggccgccgtggctgtcatcgtttttgtcctgctgcagtttccgggcatcagccgggagcacaaggccgtctatcaggcccggatcgacgaggcccgggggcagctggacgccgccgtggccgggtcgcgcttcgaggccgtcctggccggcgacgggctgctccatttcctgcgctacgaggaagcctacaaggcggcccgggccggcatcgaggacgccgaggcggccaaggccgtggacgccaggttccgcgacgagagcccggatttcttcgccatcttgaaaccccggaccgatgccgcggccaaggccgcccaggctggggtgaagggctttgccgcagcccgtgacggcatcaccctggaaatgcgccgggagcgcctggaaacgagcttcctgggcatccttggccgggcgctggaacccgtgacccagttcgcgggattcaactggcgcgtcaacgccggtctgctttcggcctttgccgccaaggaatcggccgtggccaccatgggggccatctacaagcttgaagccggcggcaacgacaacgcttcgctggaggattccatgcgcaagggcgaggccgatttcacgcccttgcacgccctggcgctgatgctcttcatggccttgtatccgccctgcatggccacctccatgatgatcaaggtccagaccggccaggccaagtggatggtcctggccatcctctatcccatggtgctcggcattgtcgtggccagcgccgttttcaccggcagccggctcctgggcctcgacggcgtcacggccatgtggagtttttacgccgtggccgtggccgccaccattctggccggccttgtgccgcaccggacccggggcatgttgtccgtggccgggaatgcctgcccggcggttcccaattcctagccgtcgatgtttcaagaagccgtaaatcccgggcgcggccttgcccccgcccgggaaaacctcaacccgcgcggacgcggatgatcggagagacgtatcatgcaactgaaaatgaaaatgcttttcgttatcgttagtctggtgctggccctgcccggagttgccctggcccacaccgccctttgcacctgctttgacaacgccgacggcaccatcacctgcgaaggcggcttttccgacggctcctcggcctcgggcgtgagccttatcgtcaaggacggcgggggcaaggtcatcgaacaaggggccatggacaagacgtccaagtacaccttcaagaagcccgccggcgcgtacacagtcgttttcgaggccggcgaaggccacaagatcgagatcgacggcaaaaagatcctggaataacgcggaaaccccacaaaggagcacgacatgcagcacaaaaaaaccgttgccggcgttttggccgccctggccttggcccttcccggcctggccctggcccacttccagatgatctacacgccggaaatcgccctggacaagggcggcgaagtggacatgcgcctggtgtttacccacccctttgaggccgggcattccatggacatgggcgcgccggagcagtttttcatggtctaccagaaaggcggcgagggcgagccgcaaaagaccgacctcaaggcggggctggcccccatcgtctggaagagcctgggcaacaccggcaaggcctacaccttcaagcaaaagctgcgtagccccggcgactatgttttcgccctggtcccggcgccctatcttgagcccgaggaaggtgcctacatgcagcagatcaccaaactggtgctcaacgtcggcggcatccccggcaactgggacaagccggtgggcctgcccgccgagatcgtgcccctggccaagccctacggcctctacaccggcaacgtgttcgtgggccaggtcttgtccgagggcaagcccgtgcccaatgccgagatcgaggtggaatacttgaaccacgccccgaacatggccgccaacagcttcgacaagaaagccgccgtggccgcccctcacgactgcttcatcacccaggccatcaaggccgacgccaatggcgtcttcgtctacgccatgcccaaggccggctggtggggttttgccgccatgggcgtggggccggtcaaagagttcgagggcaaggccatgtcccaggacgcgctcatctgggtcaaggccgtggacatgaaatagttccccccatgccgggaaccctccgggaaagcggggcgtccgtttatgggcgtcccgttttgtttttggtccatcgccggacggctcctggcgtcgcgtccttggaagcgcagaagccgtattgccggcggacacacggaagccaaggttctttcaaatgtcgacccgtccgcgcggggggagcggggacgggtcaggcggtcaggccaggccgagaatccagccctcgatggcgacggcctcgcgttcggcgtcgctcagcgacggctccaggaacgcgctcagccggccggcccggtccgtggcctggagccaagcgcacaggcaaaacgcgtcgtgttgatccggggtgcggccgttccggggatagagatggctgaccagggacggataggcttcggcgaccactgatgccccggccgggggcatgaagccgtcgaagggccagaaaactgccttgccgtcggtctcctggcggatgcgacgcagcatggtcaggccggcgaaggtcgccttggccaccgatccgggcacatcgaaatgaaacaccgacttggcccggccggtgcggatctcgcacagccgccgccagcgcgaactgcccatacgggccgcgccgtcgccaaacgcgccttggcggataaagtccacgtacatatagggctcgtccgtgggccagtgggcggcgaagtcgtcgagaaaggccggccagtcgtcgggaagcccgtactgttcgaaataggccaggggaaaggaaaacccgtggtcgatgccgaccagggtcgggatgtcttcgcccaggcgctgggcgagccagtcggttagcgcctgacggcaccagtatttgcggcccggttcggtggtggtcgcctcgcggggcgggccgtcgccgtcggcgacataggcgcgaagaccctttaaaggggaggtgggaacctcggccccggaatagtcgatgccgatgtagcgggcgaaacgaggctttttctcgggcttgggcacgaggcgcagccttgggggatcggatggacaagcgggcatggcggcgctccttgccctgaccatatcgggtcccggcgacggcgtataggggcgggcgatccgccacccggcctcccttgccgcctttcggccgatcggctatcccagggcggcgcaaagacgcaggggagcgcacgacatgtccaagaccacccgggccacccaggccctggccaaggccggcgcggcctttgatgtcctgacttacgattatcagtccggagccgagcgcatcggcctgcaagccgccgccgccattggcgaaccgccctcgcgggtgctcaagacgctcatggtgctggtggacggcaaaccggcctgctgcgtggtcccctccgacggcgagctgtccatgaaacgcgtggccgccgcctttggcggcaaggccgccgccatgatgcccccggccgaagccgaaaaagccaccggctaccacgtgggcggcatcagcccctttggcgcgaaaaagcgcctgcccgtggtcatcgaggcggcggcgctggacgaaccctacgtcatcatcaacgccggccagcgcggcgtcatggtccgcctgtccccggccgaggccgtgcgcgtggccggcgcactgtctgcgccgctgcttgcctgagcttcctgtctgcgcatccgtttttatccgtgattctggtttgttgtgacgcgttgcggcttgacggccgcgcgcggtggttggcagcgttttctcgctggtcgctggtcgctggtcgctggtcgctggtcgctggtcgctggtcgctggtcgctggtcgctggtcgctggtcgctggtcgctggcgtgtgacgctgcgaagctgctgcggctaagtgaccaaggctgccggctcaggagcaccggccagggccggacgtgccggctaggaagagtccgccagccgccgcaagaaaacaggcatcggttggcgccatggcagttcgctgacgatgcgcggcgacggacccttcccggccggcgcgtccggccggaccgggggccgccgcgccgggaatctccccggcgcggcgggcctggcggctacatggccgccgtgtagatgtcggccacgtccttgtccgtggcgcagcgcggattggtgaagcggcagatgtccttctgggcgttggcggtcatggtcggaatgtcacccgccttgacctccttgccgtagcgccggccaagctcgaccagattggccgggatgccgacgtcggtcgagagctggcggatggccttgagcgccagttcggcggcgtcgcgcggggccagaccggccgtgttctcgcccatgatggcggccatttcggcgaatttttccaccttggcgatgaggttgaacttctcgacgtagggcagaagcagggcgttgcattcgccgtggggcaggttgtagaagccgccgagctggtgggccatggaatgcacgtaaccaaggctggcgttattaaaggccatgccggccaggtactgggcaaagcacatgccttcccgggcggccagatcctggccgttggccacggccttgcgcaggtgggtgaagatgagtttcatggcttccacggcgcaggcgtcggtcatggggttggcgatggtggagacgaaggcttccacggcgtgggtgagcgcgtccatgccggtggcggccgtcagcgccgggggcatcccgaccatgagcaccggatcgtctatggcgatgcccggggtgacgcgccagtcggcgatggccattttgacgtggcgcgaggtgtcggtgatgaccgcgaaccgggtcatctccgaagccgtgccggcggtggtgttgacggcgaggtagggcatgagcggcttggtggccttgtcgatgccttcgtagtcgtggatcttgccgccgttggaaatgagcagtccgatgcccttgccgcagtcgtgggaggaaccgccgcccagggtgatgaggctgtcgcagcccgagcttttgtagagttccgtcccttcggccacgttgaggtcagtggggttgggcacggtcttgtcgtagaccgtgtagggcatggcggcggcgtcgaggagttcggtcacctgtttgaggatgccggccgcaaccacgcctttgtccgtgacgaccagcggtttgctgccccccagcgccttgatcttctccgggatgagcttggacgcgccgatgccgatgagggtcacgctgggaatgaagaaaccgtatacctgttcctgaactgccatggcgtcctccgagacggtttgatggttagatcttgcctgtacatggcatgcaacaacatcgcttatgacagatcctgtctcgattgaagcgaacgacaggacgtgtcgtgacggctgccgcagccgagtcggtcttttcctcgtgcgtcaatcggattttctggtcgagttcacgacctcgacgcggaggaaaaggcgacgcctgtggtcaggattcgttgttgttgcatacggtccggcaatgtcttgtcagcgctacagcaagaggcggaccagaactctcagaagggccgtttgaagaggatcattaattattatagtctgttggctgagacgatgcggtgactgacctagtcgaaggtgttcagaaaccggacatgtcaacctgacatgtccggtttacggccggctactggtcacgaaacgtgtccgcggagatgccgtactgcttaagcttggcgtacagcgtcgtgcgcgagatgttgagcaggttggaggcacgccggaagttgccgccggtttcgcgcagggtttcgaggatcagcgcccgctggatgcgcttaagcgacatgccggcctcgcccggggcggccggccggccccgcagcatgtcggtcatgacgtcctggggcaggtcggcgatgtcgatgcggctggagcaagccacgttgaccaggcgctcgatgcagttttccaactcgcgcacgttgccgggccagtggtgggcggccagggcggccagggcctcgcgggagatctccaactccggcttgccgagagaggcggtgaacttgtccaggaacagccgggtgagcagcggcacgtcgccttcgcgctgccgcaggggcgggatggcgatggacaggacattgaggcggtaatagaggtcgccgcgaaaggcgttgttgcgcacggctaaggccaagtccttgttagtggccgcgatgatgcgcacgtccacgcgccgggcctccttgccgcccaggcgcgtcacctcgttttcctgcaaaagccgcagcaggctcacctgagcctccaggggcatctcgccgatctcgtccagaaacagcgtccccccgtcggccagctcgaacttgcccgggctgccctccttgagcgctccggaaaaggccccggccacgtagccgaacagttcgctttgcaccaggtttcgcggcagcgcgccgcagttgaccaccacgaacggccccttgcgcctggccccggcgttgtggacggcctgggcgaagagttccttgccggtgccggattcgccaagaagcagggtggtggcgtcgccctgggcggctacccgggccagccgcaccgcctcgcgcagggccttggactggcccaggatgtgctcgaaggtgtaaacggccttggctccggccacccgggcggcgtatttgcgcatccgccgggtttcacgcagggtcaggatgacgccgccgtcggcaaagggcgcgcaggagagcgcgcacgacagctcgccttggacaagccggaaggtcacctcccggtcgtggaaggtctgccggtcagccaggatggcgcgcagcacctcgctttcgcgcacaaaacttcggatgtcgcggccgaccacgtccggggacagccccagcatggaacaggcctggccgttgaggctgacgatggtcccgtcggccccgagcacggccacgccgtcgtcgagaagttcgaggatgacgcgctggctggcgataagcgcgcgcaggcgcaaatgctcctcgatggcgtgggcggcggcttccaccagccccagggtgtgctggtggaagttctcggtgctgatggccagattgagcgcgcccaggaaccggccggtgctgtcgtggatgggcgcggccgagcagcttaaatagtgcagggaggagctgaaatgctccgcgcccatgacgtggaccggccggcgttcaaccaggcacaggcccatgccgttggtcccaagggtggcttcgtcgcagcgccgcccgggttcgccgtagggcacgctggccaggtcttcccgggtggccgacacgtgcagcaccaagccggtcgtgtccaccagggtgaccacgctgctggagaggtgaatggagtgggccagccggtccatgacccgcttggccgtgtccaccagctcccggttgtcggctacggatcgggccaggccggcggcgtcgatggggcacagggccagcgtatcggccggaaagccggcccggcggcaacgctgccaggattggagaatgaccggccgcgccacggcctcgtccacggccaggccggcctggaatcgccgccattgggccaggacggccgcggctcgctcccgggacagcggcagctgcgcttcggtttccatgaaggtctcccctgccgcctccggacggcgagccggcgtccgggcagcatagggccggggccggggcaattcaagccttggtccgcattgtctttccccgggcgaaaggctacctgtcgggcggcggttggaggccgccgcgccgtatgaacacccctcgcgacgttctcaaacaggttttcggccacgaccgcttccgcggtccccagcaagccatcgtcgagcacgtgcttggcggcggcgacgccgtggtgctcatgcccaccggcggcggcaagtcgctgtgctaccagatcccggccatcctgcgcccgggcacggccatcgttatttcaccgctcatcgcgctcatgcgtgaccaggtgcaaacgctctccggccttggcgtgcgggccgagtgcctgcattcggccctgccggccggcgcggcccgggaggtcatggccagtctgcgtcggggcgagctcgacattctctacaccgccccggagcggttcatgacccagggtttcgccaatctcctggccgggttgcccctggccctattcgccatcgacgaggcccactgcgtctcccagtgggggcatgattttcggccggaatatctgcagctggcctccattgcccatgattttcccggcgtgccccgcatggcgctgacggccacggccgacggtccgacccgggccgacatcctcacgcgcctggaactgtcccaggcccgggtcttcgccaccggcttcgaccggccaaacatccgctatctggtcgaacccaaggaccatccccgcaggcggctgttgcggtttatccgcgaggagcaccccggccagtccggcatcgtctaccgcctgtctcgggccaagaccgaggacacggcccagtggcttaccgacaacggaatcccggccctggcctaccatgccggtctggccccggccgagcgcgaccgccgccaggaccgcttcatgcgcgaggaaggtctggtcatggccgccaccgtggcttttggcatgggagtggacaagcccgacgtgcgcttcgtggcccatctcgatccgcccaaaagcctggaggcctaccatcaggagaccggccgggccgggcgcgacggcgaaccggccacggcgctgatgctctacagtctggccgatttcgccgccctgcgccggctcatcgccccggaaggcggcgagggcacgcgcacccgcattgatctgtccaagctcgacgccctggccggctactgcgagaccgattgttgccgccgccagaccttgcttgggtatttcggagaggcccggcttgagccgtgcggcaactgcgacgtctgcctggacccgagccaacccgaggacgccaccgtggccgcccagaaggcgttgtcgtgcgtttttcgcaccggccagcgcttcggggccggccatttggtcgacgtgctgctcggccggccgaccacccaggtggaacgcttcaaccaccgcgaggtgagcacattcggcatcggcgcggacctgaccaaggaccactggcgggccatctaccgccgtctggccgccatgggggccctggccccggacgaggccggccacgggggcctggtgctcacgccgctggcttgggagatcctcaaggggcagcggccctttgccatgcgcctgcccaaggaaccgccgcccaaggagcggcgcaagcgctcccggggtaccgccggggagggcggcggcaagaagagctgggtgtatgaccacctgtccacccccgaggacgcggccctttgggaccggctgcgctcctggcgggccgagacggccaaggagggcggcgtgccgccctatgtggtcttccatgaccgcacgctgctggacgtcgtgctgctaaagccccaggaccctgccgggctggccggagctggcggcatgggccaggccaagatcgacaaatacggccagacgctgcttaccatgctcgccgagcactatgccgcccacggccgggccgcgccgcgtccggccctgccgcccgaggccggcgcgcttgctccccgcgaacccaacgacacggcggccaagtccttggccctgtttcaggaactcggttcggtggaggcggtggcccaaaagcgcgagctggccgtgtccaccatccacgggcatctgctggcctatgtggcctggggtaagatcgaggcggcgaacgtgtgcggtttgccggacgagctcatggcccgggcgcgcgagaccctgtcgcggctgcggcgcgagggtgtgcccggcctgggcgccgcccacgaggctttgggaggcgcggtctcgtttgaggctctgcgctgcatcgacgccgagcttcgggccaaggcccgggacgggcaggtgtgatggcgttgcaaggggcgaccggtcccaacgacgcgcgccaaggacaggagccggccggcggattcgtgtcgcgcgcggcgaggctattggacaacaggcccctacgctgggccgccctggccgtggtggtggcgctccagggcgtgctgttcctgtcgggctaccgcctcacgcctgaccaattggctctgcaccgggtgtctatgctgggtttcgacgccatcctgaccgaatccgtggccgccgccgtggtgtccgggcgtttctgctttttcttttcgccgctgtcgtattacgccgagttgctgtccgactattttgtggtccgggcgctgtttatcggcgtctacttcgggttcttgtgggcctttgccgcctattgggcccggctggtccgggccgaggccgcgctgttgctattgctcttgctcgtgtccctgcaaatccttgatttcaacaacctgccgcccaacagcttcaccatcgcttttaccctgccggcgctgctgctggtgtgctcgcgccgtgtcttgctgtcatgggacggcgcgctctcccaggcctcgacggccaaacggctggctctttttgccgtggtgctggccgcctatctggccagcgattatgtttttatcttcggcgtctccctgctgctcctggagtacgccctggcctggtggcgtggccggggcgggttgattgccaaggccaagggacttctgcggcgcaagaaaacctggttcgacgcggccccggtggccttggccgccctggcctacggcggctggcggctgctccatccgccggcctacgccggcaccaccctggccgcggccttcgatccgatcctgatcctggccacggccgcaacccacgccgtggggggcttcaccctggcccggcccgagctctacgccgtgctggcggccaacgcctcgccgccgcccggcggctggcttccccttgtcggggtgtttgtcggcagcgccttcctgggggcggccacgctccaggagctgcgggggctggccttgggcaaacgcctggcggtggtctgcctcggcctggcctttttcgtggtcctgcccttggcgctttcgcccaagtatcagcaattgcagctggaacatctcccggcctatgtcgacagccggttcgccttcctgtgggccacggccgccctggcctgccttgtctgcctccttggccggcatctcggccacggggcgcggcggctttttctctcgatgctgttcgggctgattctcggcgctgcctcggcctacacctactatcacaatgcggacatgagccaggccatgctggagtacacggccgcctgggaccgggccggacgtctcgccgccgaggcacgtgccgtcaccggggcgggcggttccgaatcgggtcgaaacggcggccttgccgcccgcgtcgatcctttgggactggtggcgggccatcccgaattcgacctggaagcctattggcggcagtacgtcacctggcgcgaagcgcgccggggcgacgcctggcttggcgaaagcctcgggcgttttgccgcccggcccgtgacgcttactcccggccgtctctacgcggcggcagagctgcctcggcggttttacggccgcgccggctggtattggccggctgcctggggcgtgtacagccggggcgagcgggcctgtctgccgtttgagggcgtggccctcggcaaggacggtgtgctggccttcaccgccggcggggtgctggccccgggacgggtttcccaggctctggaagtgtgggtcaacggtcagccgctggcaacgctcgatctgacggccacgccggccgtgcagcagattgccgtgcccggagagcttctgtcaggcggacaggcgacgttcgaatttcgcctggaccgggcgttttcgccggcttccctgggcggggaagaccaccgtaggctcgggttcgccctgctcaacgtcctgttcgtccagccctgagtcgcacggacttggccggccggccacagtccggccatgggcggcgggcgcctgatctacgccaggagctttcacggttgcgcgggcgcggctcaaaacggagcgggcggcggaactgataaacgagacgtggccggttgcgcgggcgcagcaagaaggcggcggcaggacggcggccagtcccgaagccttcccttggagcaaaacacaaggcccgggccgacagcgtcggtccgggccttgtccatgaaaaaacgtccggctacagcttgctgccgagcttggcggcggcggtttccacgtcgctggcaaagccttcgcgggcggcgcggatgcgtccggccagttcggcgtcgcccagggccaggatggaggcggccagccaggcggcgtttttcgcgccggccccgtccagggccacggtggccaccggatagcccgggggcatctgcacggtggagagcatggaatccagcccgcccagggccgagcccggggcggaaagcggcacgccgatgacgggctttatggtgcgcgcggccacggccccggccaagtgggcggccaggccggcggcgcagatgaagatctggcagccccgggcctcgcactcgcggatgacccgctcggtgcgctccagggtgcggtgggccgaggtgacggtaaagatatgttcgatgcccaaggaatcaaggaccttggagcaaggacgcattttctcttcgtcggacatggagccgatcaaaatggcgatgcgcatctattttccctcccgtttaaggcccttgtcgccgatgtcgcggcggcaaaaggccccgtcgaaatgcaatttctccacagcccggtaggccgtcgccttggcctgggccagtccgtcgccaagggccgtcacgcccagcacccggccgcccgaggtcacgacctggccgttaacgagcttcgtgccggcctggaacaccttgaccagcccgtcgccggccgcctcggccgcctcgatgccggtgatggccatgcccttggggtagctgcccggatagcccggcgcggccatgaccacgcacagggcgcttttgtccgaccagcgcaccagttccgggctgagcttgccggcccggcaggccagcatgatggccggcaggtcgctagccaggcgcatgagcagcggctggcactccgggtcgccgaaacggacgttgtattcgagcaccttggggccggcctcggtcatcatgagtccggcgtagaggatgccggtaaagggatggccgcgcttggccatctcctttaaaatcggatggatgaccagatccatcatctcggcgtagcgcgcgggcggcaagaccggggccgggcagtaagcgcccatgccgccggtgttggggccctggtcgccgtcgaagaccgccttgtgatcctggcaggcggtcatgggcacggcggtttccccgtcgcaaaaagccaggaacgaggcttcctcgcccacgagcatttcttccacgaccacggtgccgccggccgcgccaaaggccttgtccaccatggcttcgtcgatggcggccagggcttgggccgtctgcgtgcagaccgtgacgcccttgccggcggccaggccgtcggccttgaccaccacgggccggccgaggtcctgggcgtaggcccgggccttggccgcgtcggtaaacgacgcgtaggcggcggtgggcacgccggccgcggtcatgacgtccttggcgaaggccttgctgccctcaagctgggcggcgtaggcgtcggggccgaagcagggcacgctggcggtttccagggcgtcgcgcaggccggccaccagcggcgcttccgggccgaccacgaccagatccatgccccggtccttggccagggccacgatgccgggcacgtcggtatcggaaagcggcacgttctcgccgcaggtcgcggtgccgccgttgcccggcgcggcgatgaccgccgacacgtcagggcttttgagcagggtatgggccagggcgtgctcgcggccgccggagccgaccaccagaatgcgcatgtcgcgcctccttgggcgggggataggcccagagcgtccggccttgggagaccccggccggaaccatcgggaacgctccccgcgatattggctgtcgtgggggacgagcggccgggcaacccggcaaagcccatcccaaaggaaaaaatccattagccgtaacgcccgaaaaaggcaaaccggtccgggagcctggcaaggctcccggaccggcgtaaaacggctttccaggcctaaatagcctacttccaaggggggggccggacccgtttgagcacccttggccgcttgcccgaaaaaaatgactcccgaagtattttattggccaagggccctgggcgcgtcgttcgcgctacccaggctgaccatcaggctgttgagttcctgggcctgccgggccagatcggacaccgcctgggccgactggtgcatggcctgggcagtttcgtgggcaatggaacttatggattccacggagcggttgatttcgtcggaggtggccgactgctgctcagccgccgtggcgatggcccggacctgatcgccggccgcctccaccacggagacgatttcggtcagggccgcctcggacttctcggccagccccgaagccgtctcgaccttggaaacggcgcgctccacccgggacaccgcgtcggccgtgccgcgttggatgccggcgatggcctggcccacttccttggtggcgttcatggttttttcggccagtttgcggacctcgtcggcaaccacggcgaagccgcgcccggcctcgccggcccgggccgcctcgatggcggcgttgagcgcgagcaggttggtctggtcggcgatgtcggaaatgacgtccatgatggccccgatgcccttggcctgatcacccaggctccgcatgttgtcggtcaggaccaccgcttcctcgcggatggagcctacggcgctctccacgtcggccacgagcttcgcgccgccccgggccttgtccctggccagttcggcgctgccggccgtggccgcggcgtttcgggccacttcgatgatggtggcgttcatttcttccacggccgtggccgtctcctggactcggccgttttgttcctcggctccccggctggactgctcaatctgggccgagagttcctcggaagcggcggccacccggtcggccacggccgaggcgctggcggcggtttgggcgatgaccgcgtttttctcctcgatttgctgcttttgctcatagagttcggtgatgtcgttccaaaaggagatagagccgagcagcgttccgtcgaggtcgtaaaagggcgtggtgcggatggcgatgcgcagcttgcggccggtcacggtggtgaagtcgttttccgccgcgagcatccggcgttcctgaatggcccggtcggaaagggtgttcttggccggatcgttcaagtagaactggcccgaggtttggccgacgaaggatttgccgggttcgtatttgtcgaggagccggctgatttcttcgttgtgccacagcatattgaagtccgggccgacgatgccgcagggggaggggatgccgtttaacacgccttgggcgaagccgagtttggctttgagttcggccaccatctggcgcaggttttcgccgaaggccgccagttcggcccgaagcgggcactggatggcggcgtcaaagtcgccgccggccaccttggcggtgaaattgctcagacacagcagcggccgcagcaccagccggcgggtgatgagcacgatgacggccacggccagggcggccacgcccaggcccagggccacgagcgtattgcgctgctcgccggccagggtcgtcatctcgtcggtgtaataggacatgcacacgagccaatcagtggagggaatgcgggccacggccatggccttgcgctcgccgttccaaaggtaatcgaaggtgcccgagcccttgtccatggccgccttgaatgtcggattggtggcaaagctctggagcaacagtttctggtccgggtgggagataaaattgccgtcgctatcgaccatgaaaccatagccgcgttttccgaagcgaatcggatccatgatggcggcggtgaaacgtccccaaagcggagcggcggcgacgccgcccaggagcttgccgtccgggccgcgcaaggatttggctacaacatagatgagttccgagccggatccggactggaagacggaccggctgtggaccgtgtcctggccggccaggatggctttgacgtaatcccggtccttgcggtcgccgccgctgatgtcctggccattggagttgtagccggcgacgattttgccagaggtgtcaaagacggtgaaagaaaagaaatccttatggtttttgatgaaggagagcaataacctctgggtctcttccttgtttcccgaaaaaacagccttgatctcgtcctgggcggccagggaatcaagcaccgaggccgtgcccttgaggtagatgtcggcggcgcgggcggtgagggcggccgtttgttccaggccgctttcctgcacgttctcgatcatggtgaacgaacttttcgcgacgtaaatcacgagggccgcgacgccggccagaatggtcgcggcgacggatgcggcgatgatggtggtgatgcctgacttgcccatggcgttctccttggtatgcggcgtctggcgctgtttggacgccgcatcggtggttgctattgcgccacagctgactgtcaccactctgggaacgacaagcggtcgggtaaggggctgctcggtgcaggcccctgcggtgtcggcaaccgcagggcgtcatgtaggaaaacgccgcccgcacggccgctgctgcggactgtgcggacggcgccgtatgcggacgacccggcgtcgcttgtgggcaatgggggcaatgtctactttgaaaatgggaaatgggcaagccttacgtcagcccttttttccctggggcagggcaaaaggcttggcatcctgttgttggagatcgcgtatcagttcattaagattgtttgccagatcagccagttcgcgcaccgcgtcggcgcagtggtccagggtgtcggcggctttggcggccagggcgttgatgtcgccgacggacgcgttgatggcttcggtggtggcggattgctgttcggcggcggcggcgatggaccggacctggtccccggctccggccacgaggtcgacgatgcgggccagggcctggcccgagcgttcggacaagccggtggcgtcggccacccgggcggcggcctgatccatgcgggaggcggtctcgtcggccccgcgctggatgccggcaatggcctggcccacgtccttggtggcggccatggtcttttcggctagctttctcacctcgtcggccaccacggcaaaccctcgaccagcctcgccggcccgggccgcctcgatggcggcgttaagagccagcagattggtctggtcggcgatgtcggaaatgacgcccatgatggccccgatgcccttggcccgttcgtcgagttcgcccatggtggcggccagggcggcggattgctggcgcacggcgtccacggccttggccgcctcgccggccagccccgccccttcatcggcggtgtcccgggccttttccgccaggctggcggtgtcgccggcgtttctggccacgtccatgatggtggcggaaagctcggccacggctgaagcggtttcctggacgcggtggctttgttcccgtgccccaaggctggcttccccgatgctgcgggccagatcgtcggcggcggcggccatgcgatcggccacctgggaagcctggccggccagactggagatcagcgcgttttgctcctcgatgcggtttttctggctcacgatgccggtcatgtcgttccagaagatgacgcaaccaagcagattgcggtccatatcgtaaaacagcgtggtgtccacatgcagatgcaggacacggccgcgccgggtggtgaagtccaggtcgagggaaagcccgcgcccttcgcgcagggtgcgttgggaaagggtttcccggttcgggtcgccgtagaagagttggccggtcacctgccccttggccgattccggggtggcgtcgaggtcgagcaggtcgatgacctgccggttgagccacaggatgcgcccgtccgggccggcgatggcgcagggggccgggatgccgtcgaggacgccctgggagaagccgagcttgtttttgaggtcggccaccatggcgctgacgctggccgccaggtcggccagttcgaagcggaagcggccgacgagttttgctccgagattgccggccgtgacctcacgggcgtaggcggccacccgggttagcggacgcagcgccatggcccggttggccagggtgatgccggccacggcggcgacgaggcagcaggccccgatgaccaggagcaggttgcgctgggcggcggcggtagccgtcatctcggattcgtaagcggtcatgcacacgacccagccggtaagtgccaccggcgcaaaggccatgaacttgcgctcgcccttccaatcgtaggcgaccacgccttccttgcgggccaatgcttccttggcaaagggctggtcggccatgcttttgagcagcagttccttgtcggcggcgtgggcaatgacgttgcccttgccgtcgagcatgaggccgtagccgcgcgtgccaaagcgcagggggtcgatgaagttcttggtgaagacgttccatttggggcacacggccacgccgccaagcagcttgccgtccgggccgcgcacggccttggccaccacgaagatgaggatgtcgccggtcttggcgctcatgatctggtcggtgaaaaagaggtctttgccgccgagcacggctttgacgtagtcgcggtcggagcggtcgccgccggccatgtcctgcaggttggcgttgaagccggaaacaaccttgcctttgagatcgaaggagaagatggcccagtagtgcttgtaactctcgatgtagttgcgaaaacggtcctgggagcgcttggcgtcgccggacaggccggcaatgacggcgtcctgggtggccagggcccgggccacgtcggcggcgtcttcgagatagaggtccagggtgcggctggtggaggaggccagctggcttaaggccgtttcctgcaggtcggaagccatgcgaaacgaggtgcgcgagacgtagagcaccaggacgacgatggcgacggtgacgcagccggcgacgagcacggtgagcacggtgttgacgctgcccttggccatgagccctcccggggattgggtcccacgggcggccggaagatccggcggcggcaaacggccaagagacgccctgagacgctgttggcaggaattattacggaacggcaacgaaaagcgcaacggcaaaacgtgataatatccagcttgtccggcggaggccgccggccgggacaggggcggctcacgcgccgcttgcggaggcccggacgaagcgcgggcgagtgggggctggtttggggcttgcggccggcctgtcgagagactggcgggcggcatggcccaagggcgttctcctttgcggcgctggtgtccgccgccgtgaggcgtgcctcacggcggtcagtgcatgttggtaaaaaggggcaaacgctaggccgtcagcgcggcctggccgctgccgcccttgatgtcggccaccagggtgttgagttcgtgggcctgggcggccagctcggtgacggcctgggcggactggcccatggcttcagcggtttccgaggcgatgcggctgatggcttccacggcccggttgatctcctcggaggtggctgattgctcctcggccgccgtggcgatggcccggacctgatcgccggcggtttccaccaccgcgacgatttcgcccagggcgtcgccggaacgcttggccagggccgttgcctgctccacggcggaggaagcctgttccaccatggtcacggtgtcggccgtgccgcgctggatgccggttatggcctggcccacttccttggtggcgtgcatggttttttcggccagctttcgcacttcgtcggcaaccacggcaaagccgcgcccggcctcgccggccctggccgcctcgatggcggcattaagcgccagcaggttggtctggtcagcgatgtcggagatgacgccaagcaccgcgccgatgccctgggcctgctcgcccaggccgtgcatgttggtcttgagcttgtcggcagccagccgcaccttgtccacggcggccacgacatccaccaccaggctggccccttcccgggccttgtcccgggcggcggcggcgttgccggcggtctccccggcgtttcgggccacttccaggatggtggcgttcatctgctccacggcggtgacggtttcctggacgcggtggttctgttcctgggcgccctggttggcctgttcgatctgggccgagagttcctcggcggccgaggccatgcggtcggcggtgttggaggcggcgtcggccgtgtcggccatgagcgcgttctgggcggcgatgcgctcctgctggaggtagcgttcggtctgatcgttccagaaggaaatggacccgaggagattgccgtccatgtcgtagaagggcgtggtgatgacatcaatgcgcagtttcttgcccgagggggcggtgaactcgttgtgggcggcgatggcccggcgttcggccagggcgcggtcggagcaggtctccctggaggcgtcgttcaaataaaactggccggatttctggccaaaaaaggtttcaggcggggcggttttttccaacagatcgcagatctgcttgttggcccagagcatgttgcagtccggcccgacaatgccgcagggggcggggatgccttccatgaccccctgggcgaagccgagtttgtttttgagttcggccaccatgcgttccaagttgtgggccaggccggccagttcgaagcggaatcggccggacagcacggctttgaggtcgccgccggccacggcggcagcgtaggcggcgatggcggccaggggcgagagcaccacaatcttgttgaatatgatgatgagcccggccacgagcgccagcacggccgcgccgatgaccagcagtacgctgcgttggcccgaggccagggcggccatttccgattccgaggcggtcatgcacaccagccagccggtggcaggcacttcggccacggccatgaactttccctctcccttgaacatgtaggccatgatgccgtttttcagggccagggcgcggtccgaaatggttttgtcggccggcgcgctaagcaccatggatttgtccttggcatgggcgatgacgacgccttggccgtccagcatgtaggcgtagccggactcgccaaagcggacagggtcaagataccgcttggtgaaattctcccagatggggctgacgatgaccatgccaacggttttgcctgccgcgtccttgacggcatgggcggccacgaaaaggagcgtgccgctggtcttgcccttgaggatggatttggtgacgtagctttgttgcccggccatgatggccttatagtattcgcggtcggcgtagctcgcggccaggccctcgccgcttttcagggcgccggccacgggtttgccggacgtgtcgataatgagcgcggaaaagaggttgtcggcgttggcgataaactggcgcagcatggtttgggcagcctcgggcgagccggacaaggcgttgaccacggtaggctggctggccaggctttccacctggtcctcggcgctgctgatgtagagttcgaggatgttgccgaggtttttggcggtgcgctccagggcttcctgttccagatgcagggaaatatcgtaggtcgatttggcggtgtagccgatgatgccggcaatgccgcagaaaagggacgccaggacggcgagggtcagcacctgattgaggccaaggcgtttcatggggcaatctcctcgaatggcgcgctccaagagtcatcgatgcggcgagagaacgcatccgggcaggagcggcgggcaagaaaatggggggatgtgctcgggccgcgcttggccgggaacagcttgcggcgcgtggcgccgccggcgtcttgtcagtccgagttctggcgttggtagctagaggaaaggacggtacattactagaacctttttttggttttatttgacaataaataaataccaaaatactctttgtccttgtagtattggagggttggcatgacgccgggaagaccgcgggcggtgcgactgggtggaacgggcgacaagctctatatggcgctcaagctgctggggctgtcctggagcaccagggtcgaggcggagcggctgaccagtgacggtcactggcggcaatgccgcctgccgcgcagcgtcaacaccgtgctggaagacatccgctgcggcatggcggccgagcgcctggagcgctacgcccagttcttcaaggtttcggcggggctgtttcttgacgaggccatcggggcctatgctcccgagttctcctgtcagatcctgaaaagccgccacgacgcccgggccgtcagcccgtttgacttcggacgcggcgtggtcagcctggagctgctcaaccggcaaaacgacgccgtctatttgaacgacctgctcggactgcttggcggctgctacgatctggccgtgcgcaccgcgccctcggatgtctggctcctcggcgcggccgtcatcggcgaaccggccgacgacgccatgcaaaccgtgggcgtgctggccgtgcccgacgcgcctgtcgatttccacggccgcatcttccgttggcacaactatctccatgtgcactacgcttccacggacaaccagctcatcggctacatgatgacccccgaccccctgcaatcggtactggtgcgccaccggcggccgttttacatgaagttcaacgccctggccgggaatctggttccctcggcccagcccgatatctccgtcatctacgcgctgcgccgggcggaaccggcggcggccttcgaggaattgcgtcgggcggccatccagcgaccgattttggagccgggccatccccgttatgaggtgatcatggaaatgttgacccgggccgaggccgctccggccgagaacggcgcggccagttcctgaatccgtctgtccgggcgcggcccgggaccggccaggagccgaagcgccggccgaacccattgcgggacttcttcgggtgccgccgccgtgagctgtcggccaaggctcgcccggccggttgtcgcggcgcggctccccaaaatgtgaacggccctttccggtttttccggaaagggccgtttggcgtggcgaaacgtcgctggcgcgtcaggaggcgatggcggcctggccgccgctgccgcccttgatgtcggccaccagggcgttgagttcgtgggcctgggtggcgagttccgccacggcctgagcggattggcccatggcgtcggcggtttccgaggcgatacggctgatggcgtccacggcccggttgatctcctcggcggtggccgactgctcttcggccgccgtggcgatggcccggacctgatcgccggcggcctcgaccaccgagacgatttccccaagggccgcgcccgagcgcgaggccagggccgtggcctgatccacggccgcagccgcctgatccaccatggtcacggtgtcggccgtgccgcgttggatgccgctgatggcttggcccacttccttggtggcgtgcatggttttctcggccagtttgcggacttcgtcggccacgaccgcgaaaccgcgcccggcctcgccggccctggccgcctcgatggcggcgttaagggccagcaagttggtctggtcggcgatatcggaaatgacgcccagcaccgcgccaatgccctgggcctgttcgcccaggccccgcatgttggtcttgagctgttcggcggcgtcgcgcaccttgtccacggcctccatcacgtccacgaccagctcggccccttcgcgggccttgtcccgggcggcggcggcgttgccggcggtctcgccggcgtttcgggccacttccaggatggtggcgttcatctgctccacggcggtgacggtttcctggacgcgattgttctgttcctgcgcgccgtggttggcctgctcgatctgggccgcgagctgctcggcggccgaggccatgcggtcggcggtgtgggaggcggcgtcggccgtgtcggccatgagcacgttctgggcggcgatgcgtttttgctggttgtggagttcggtctggtcggtccagaaggacagcgcgccaaggagcgtgccgtccatgtcgtaaaacggcgtggcgacgatgtggacgttaagggtgcggcccgagggggtgacgtattcgctgtcggcttcctgggcctggcgctgggccagggcgcggtcggagcgggtctccttggaggcgtcgcccaggaagaacagaccggacttctggccgacgtagctggacggggcctcggacttttccagcagatcgcaaatctgctggttggcccagagcatgttgcagtccgggccgacgatgccgcagggggcggagatgccttccatgacgccttgggcgaagccgagcttgtgtttgagttcggccaccatgcgttcgaggttgcgggccagatcggccagttcgaagcggaagcggccggcgagggcggccttgaggtcgccgtcggccacggcggcggcgtaggcggcgatggcggccaagggcttaagcaccaccacccggttgaagatgatgatgagcgcggccacaagcaccagggcggccgcgccgatggcgatgagcacgttgcgctgccccacggcgcgctgggccagttcgtccgaggacacggtcatgcacaccaaccactggacgccggagatctgggccacgcccatgaattttttctcgccgttgtaggcgtaaggcatgacgccgtttttgagcgccagggcgcgctcgccaatggtgcggtcggcgggctgcttgagcaggagcgacttgtccttggcgtgggcgatgatgcggccctggtcgtcgaacatgaagccgtagccggtctcgccgaagcggatgggggacaggtacttgcggatgagtcggttccagtccgtggccagcacgatcatgccccgggacttgccgtccgggccgtgaacggcgtgggcggtgaggaagtagggcttgccggcgtcgtcgacgcggatttcgccgctggtgaagtcgtcgctgccggccgtgatcttcttgaagaagtcccagtccttgtaggaatcggccaggggcttgccggatttgtagacgccggagacggccttgccgtcgttgtccaccacagccacggccagcagggaggtggagcttttgaggtagccttccagcattttctgggcccggtcgggcgcgccgatcagcgcttcgagaaagatcggcagcgaggccagggtgtcgacgctttccttggcggtatcgaggctcaagccgattaggttgaccatgtccgtggccgtgcgctggagttcctcctcttgcagggaggtggaaatctcgttggtggagacggcggcgtaggtgatgatggcggcgatgccgcaaaaaagcgagacgatgacggccagggtcaaaacggcgttgaggcccagtcggcgcatgacaatactcccgtatgcggtaaatgatgctgggtgcttaaggccaggggagcggcgacggacgtcgtctgacgtgcggcaatcggcaaggccgatgaccggcgtttttccaagattggaaaaacgcgccccccttgggcaagggatacgaaaaacgcggccgggaagccagcagtattttttgcgccaacattcacgtgatgttgacgttttcgtgtcggtgacgcgacttgtcgcggacgatgttcgttttctggccgaaaaatgcaatgtcggctgcccgattcgcgtcatcggggagcggtcggcggcaaacgccgcaagaccagggcgctcgatgtgcttgtcgcgtcagagttacaagggaggcggccgatggccccaaaggcttggcgcgtcggccgtggcggcgtgaggcggccggaaaacgcggttggcgcggcggcgaggggcagcagaggtctgtacaacacccaagcgacggcgtacgttcatgatgcgctatttccgataacggccaacctgcgtccccggagaccgcccatgagcaacggcgtattcctcctcgtgctgatcggcctcggctttgcctttctcatctacttccatcagcgctccaggaactatcaagagcgccatcccggggaggataacccggtggacaagtggctgacgggcaaggacaaggacgatgaagacgattcggacgcgaaacgttgagaggcggacggcggcaacgtgcttaagcgcattgccgccggataggcttggagaacgggcagcccaggccccgtgtcaggcttgggatacggtgttacggcagaaaacgcccggtcaccgaattcgggtcggctttgagttcctcaggcgtgcccttggccacgatgcgcccgccgccctcgccgccgcccgggccgaggtcgatgacgtggtccgaggccgccaccacgtcggtgttgtgctcgatgaccaccacgctggctcccttgtccaccagccggtgcagcacggtgatgagcttgcccacctcctgcatgtgcaggcccgtggtcggttcgtccaggatgtagagcgccccgggcaggctccgcttgcccagctcccgcgagatcttgatgcgctgggcctcgccgccggacagcgtcgtggccggctggcccaggtgcaggtactccaggcccacttcctccaggacttccagacgccggtccagcaccggatagttttcgaaaaactcccgggcttggcgcacggtgaggtccagcacctcggcgatgtttaagcccttgtagcgcacatccagggtctcgcggttgtagcgcagcccgccgcagacctcgcaggtgacgtagatgtcgggcagaaagtgcatctccacccggatctgcccgtcgccgccgcaggcctcgcagcgcccgcccttgacgttgaagctgaagcgcccgggcttgaagccgcgccgtttggcgtcgggggtggtggtgaagatgtcgcggatctcatcaaacaccttggtgtaggtggccgggttggagcgcggggtgcggccgatgggcgtctggtcgatgctgacgatcttttcgataagtcccgctccctcgatgccggcgatggccccgggcgcatccaccttgatgcccttggacaaggccaggtgcttgtacagcgtatccatgaccagggacgacttgcccgagccggacacgcccgtgacgcacacgagacaccccagcggaatggtcgcgtcgatgtttttcaagttgttggtggtcacgccgcgcagcacaagttcgcctttgggcggacggcgcgattcggggcggggcgaggcggcctcgccccgcagatatttgccggtaagcgatgtgggcgaggcgagcatgccggccacgtcgccctggtagacgatctcgccgccaagccggcccgagccgggacccagctcgatgacgtggtcggcgcttttgatggtggcttcgtcgtgctcgaccacgagcacggtgttgccccggccctggagctggcgcagggtcgccagcagccggtcgttgtcccgggggtgcaggccgatgctcggctcgtccaggacataggtgacgccgaccaggcccgagccgagctgtccggccaggcggatgcgctgggcctcgccgccggacagcgtggccatgttgcgcgacagcgaaagatactccagccccacgcccgagagaaacttcaagcggtggttgagttcctttaaaagcggctcggcgatgaccgcctcggccccggtaaagtccaggccggccagccagggcagggcgcggtcgatgggcatggcgcaaaaatcggcgatgctggcctcggccacgcgcacggccagggcttccgggcgcagccgcgccccgccgcagaccggacacggccgcgactggcggtagcgggccagctcgtcatgccagaccgggccgaaggactggcccttttcgagcagactcaccaccccggcccagccaaaggcggcgtcgccgtaatacagcgcctggagcgcctcgggggtgaaatcggccagcttggtggccagggtgaagccgtggcgcgcgcccaggttttccagctgcttgctgtagcgggccagggcccgttcgctcttccagggcaggatggccccttcggccagggacaggcccttgttgggggcgagaagcgccggttcgaagtattccaccgcgccgatgcccgaacaggctgggcaggccccctgggggctattaaaggaaaagagctggggcgaggggcgcggcacgctgattttgcaggtggggcaggacgaggccgtggagaagatgcggtccttggccttgccctcatggtcggcgatgtagatgcggccgtcgccctgggccagggccagctccaccgaatccgacaggcgcgagcggatgccgtccttgaccaccagccggtccaccaccagatcgatgttgtggcgcttgtttttttccagttccggcaacggctccaggggcacgatctggccagccacgcgtacccgggcaaagccctggctcttgagctttttgagcctgtcggcgtgggtccccttttgatgctccaccagcggggccaaaagcagcagcttggagccttcgggcagggccaggatgtcaccgatgatctcgtcggcggtgcgggcggtgatggcctcgccgcatttggggcagtggggcttgcccaggcgggcgaaaaacacgcgcaggaaatcgtagatttccgtcaccgtgcccaccgtggagcgggggttgcgcgtggccgtttgctgctccagggagatggccggggacaggccctcgatcttgtccacctgcggcttgtccatctggggcaggaactgccgggcgtaggcggacagcgattccacgtagcgccgctggccctcggcgtagacgatgtcgaaggccagggtggacttgcccgatcccgacgggccgcagaccaccacgagcttgtcccggggaatgtccagggtgaggtttttgagattgtgctggcgcgcgccttcgatgcgaatccggggagtctcgtccatcatgcctccaaactgccaaacgacaaggaggcaaaataaggaccctggccggaaaggcaagggcgattgccaaaatgtcgccaatcgggcacaccctggaagctcatggactgttttctggcccgggctgcggcgcatttcgaggccggccgacgttgggaatcgttgcggttaacactcgtttacattatgtcgatcttgccgggccgcccgcgcggcgttgccccggcaaaggagcgaccatgcgctacgaggtcccctttgtgcccgatccggcctacggcgcgctgctcgccggcgcggcggacaggctggccggcgtctacttccgcctcgggcccgaaaccccggacgcccggatgcccggcttggccgatccctcgcccatggaattggccgccggcttgtcgggcctgccgcccatgccccgtttgggcctgctcaacgccgccttccacgcccaggaaaccctgtccaaggacgggctgcgcgatctgctcatgctcctcgacggctatctggcggccggggcgctgaccggcatcgtctacgccgaccagtaccttttgcaggccttgtccgatgcctcgccgtcggttgcccgggagctgtgcgccgtgccgggcatcaatttccggctggacaacttcgagcgggcggcggccgtggtggacgcggcctgctcctcccggtttcgcccgccgccgcgcatcatccttgaccgtgacgtcaaccgcgacctggacgggttgaccgccatggccgggaagctgcgccgggagtggccggacatgggactggggcttatggccaacgagggttgcctgtacgcctgccccttcaagcaggcccacgacgcccacatcgcgctgtcgcgcctggccgcctgccgggtcgggccggatctcaaccgcgacctgggctgcctgcgcagcttcgccgaagcgccgggacgcttgctcgcctcgcccagcatccgccccgaggacgccgggcgctacgaaggcgtcgtcgattgcctgaagctgtgcggccgcagccggccggcggccgatgtgcgggccattgtcgcggcctatctggacgggcgctttgacggcaatctggtctggcttctcgacgcccaggaggcgctgtccgaccgtttcgccatcgacaacgccgccttgcccgaggattttttcgaggttacggcgtcctgctcccggcgctgcgccgcctgccgttactgcgacgaactggccgagcggctgcttgtcacccgcgcccccggccttgtgccctacggagccggctgatccggccccgcccgtgtcgggccagggctacaggctcggccgatagcgggtggggtcggccacgccggcttcctcgaagcctttccttcgcagcaaacagctgtcgcagcggccgcaggccaggccgtccggggccgggtcgtagcaggagtgggtgaggccatagtccacgcccaggctcgtgccgagttccacgatgccggccttggacagatgcagcagcggggtgtggatgcggatggccagccggccttccaccgcctccttgacggccagattggccatggcctcaaaagcggcgatgaattccggccggcagtcgggataacccgaatagtccagggcgttgacgccgatgtagatgtcgctggccccgagcacctcggcccagcccagggccatggacaggaagatggtgttgcgggcaggcacgtaggtgaccggaatgtcggcttccatctcaccaatatcgcggtccttgggcacgtcgatgtcggccgtcagcgccgaaccgccgatggaccccagcggcagaggcaggatcaggtgggtggtcacggccatggccttggccacccggcgggcggcctccagctccaccttgtggcgctggccgtattcgaaactgagcgcgcacggcaaaaatccgtcgcgccgggccacggccagacaggtggtggaatccaggcccccggaaaaaaggaccacggctttttggggtgcgtcggtcgtcatagcggccgtctccttgtcagacgccccgggcgtcggggctccagatgtgcttgtgcagttgcagccccaggcgcgcctggacccggtcggccaccatccaggcggccagctcggccgaggcaagggtcgcggccacgggcgaaaaatggacgatgtgagtgcgccagatccgtgaggcgatgtccagggcgaaatcgtaatcagtccggtcggccagcacgaatttcacctcgtcatggggacgcagccgctccagattgccgtaatcgttgcgatgctccatgccgctgcccggacatttgacgtccaccacggccgtggcccgggcatcaagcacggcgatgtcgaagctgccgttggtctcgaccagcacggtcaggtccagatcgcacaggcgcttgaccagctccggggtctgcggggccagaagcggctcgccgccggtcacttccaccagcggcagccccagcccggccagggcggccgtggcgtcggccacggtcatttcggcgtaggaatccccggcatggagggtgtcgcaccaacggcaggccagattgcagcccgacaggcgcaaaaaaccgcagggccagccggcatagctcgactcgccctggatgctggcaaatatttcatgaaccttgagcatcacgcctcgcggcaggtggcggccaggccacggctttccaccaccgtcacggccgtgacgcgcacccttccgtcgtcgagccgagccttgagccgcgagaggatgtagccggccagcacctcggccgtgggcggatcaagggcgggcacgtcgtttaggcaggcgtggtccagatcggcgaaaatggcgtccatggccgtgcggacatccaggaaatccgccaccatgccgtttatcaggctgtcggcgcagatttcggccgtgacctggaaattgtggccgtgcatggcggcgcaggggccgggatggcccggcagacggtgggcggcgctgaagtcgccggcaacggcgatggtatagatcggcggcatggctgggactctccctggcgttgaacatcggggcgaggaaagctatggagggtcgcccgaaaggtcaagacaaccacggccgctcccggccgtcaaggagacgtacccatgccgcatcgcgtacccagagacgacgtcagcacgctcaaaaccctcggccagggggccacggtctacccgagaaacgtcacccccggcctgctcgaaaccttccccaacgccttcccggaccggcgctacgacatcaccttcgcctccgacgagttcacgagcctgtgccccaagaccggccagcccgacttcggcaccatcaccatccgctacgtgcccgacaagctgtgcatcgaatccaagtcgctcaaactctacctcttcagctaccgcgacgaaggcgctttcatggaaaccctcaccaaccgcatcctcgatgacctcgtggaagtctgccagccgcatcatatggaagtcaccggcgacttcgccgcccggggcggcatcactatttcggtgacggcgacgtttgtgaaagagaagaaatagggagagataggaggaagatgcctccggcggctgggggcctgaggcccccagaccccccacttgggaaaatggggaatcagctccgcgagcggcgggccaggcggccggcgcgcaggcggtcgaagaggctggccggcgacagccgccgccgcagggccgacgggccatggtcgcgccgccacaggcgcaagaaccaggctccccacagcaccagacaggcgttgtactgcagccacaacaaaaacagcaccgccccgcccagggaaccgtatacgagttcgtagcgcccgccatgggccacgaactgcccgaaagccgccgtcaccgcccaggccgcgacggccagcaaggccgacacgccggcgatggcccgaagcggccgccgccccggcaaaaacagcagataggcggcggcgaacatgccggtcaggcagagaacgccccaggccgccgaccactggcgcgccagactcccgcgcggctccaggcgcggcagataggccagatacagggccgccgtcagcgctcccaagaacaagacgccggcaatcgccccccaggccgtgctcatcaatcgcgcggccaggggcggccgttgttccggggccgcctcgccaagaggccggcgtagcgcccggcgaaacgcgcccagaaacagccacgacgaccacagcacaaacaccgcgctttccagggaaaaccccggcgaggcccacagcagccgcctggcccgggagaccagcagttcgtcgatatacggcgtgaggatggcgagctggcggcgtagggccatttggccggtccagtcctcgcccgacaccgccccgcacagggccagcatggcaaaaagcagcggcaccgaagagagcagcgcgtaaaaggctagggcggcggcctgggtcggcccgcccgagcggaaaaaggcggccgtggccttgacggacaagcgtccgacctcccgcagccaggcggtaacatcacgtcgccgcaaccgggtcaggatcaaggcttcgcgcctccggccagccaggcggtccagcccaggggcgcgccgccgggattggcccgggcgtattcgtaaaaccggcgcagaaattccaggcgctgccgggccagggcgtcgcggcccggggcgctgccgtcgctggtcttggccagatccgagccgcccagggccttttggcgggcgatgatgtcctcgaaagccacgctaggagcgtttcgcagcatgtcgaccagggtcatgaaggtggtggtgcgtccggccccgccccggcagtggaaatgcagccagacgtccgggggcaggctgcgggagaatcgcacgaaccgttcgaccacggcgtcgtcgggccgggtatggtcggacacggccaggcgcagatagcccaggcccagggacgcggcggcctgggcttcgctgacggcgggtagcgggccgagggtcaggggggtggggccaccgcgcctggcttcccgggccacgacgatgtccggccgctcatcgatggcggccaggagggcggcttcggcctcggccacgaaagcagcgtcgcggcccgggttgccctggttgtcgggcagccgccaggacacggcattaccgccgagaaaaccgtgggattcccggcgcagatcgacgatgacggcgcgcggcggaaattgttcgcgcataagggccagcccggccagggagaactggctgctgccggagacgcgcagcccgtttaagccctcccgtgaggggacggcagccccgtccgacgcggtcagggggaaaaaacaggtgcgaaaccgatggggcagggcgctggcggcaggggcgtccagggtcaaaaccccgacgtccggtccgggttcggccgaggcggcagcgctcggaccggccaggaacagggccaacaccacggccagcagcccggccaggggccagggcgccgcaaggcgcggccgagcggaccggcgaagccggcggcacgacggcggcagggcggacatggcttcctcctgttactgggccagccccagggcgctgcggacttcggcccgggcggcggcgtactgctgctggaattccgggctgttgaacaggaaggcggcgatgaccgtgccggtgatgcggccggcggccacgtcgctgggatagtggacgccgccgatctcccggttgaagcggtactgctcggcccgggccgccagggcttgggccttttccgggaccatgttggccaggatgatgcccatcaaggtgccgtaggtggaatggccgctggggtaggaggcgttgccgggcttgggcacgcagggatcgatttgcgaactagcggcatagggtcgggggcggtcccagtgcttcttggcgttgccgagaatggcgtcgccgttttccttgaccgccttgaaaaaggccgccgccacgggtagcttttcagccgtgaactgggggccgaccacatcggtgaagcggaaaacctcgcgggcggcgtcggcctgggcaaaggccaccatgtccggggtgcggtccttttgcagttgcaggagcagggcgatctcgtcgcgctgctcggccgagtccatggccggcggcggcggcagcagccgggccagatcgacttgctgcgggctgacgaactgcgtttcggaccaggccagctgcggcagcgacagcagcaggaccagcaggagcaggcggaaccgggcaagcatggcggacctccttgggttgacgggcatggggccggccgggacggcgcagccggggctgggcaagttatagggccttggccggcggctgtcacggccggggctgcaaccggcttgggctttggagcgactgacgggcatcggcgcggggggttggggggatgggagtgtccctggcctgcgccggcctgaagcaggacgattgtggaatggattctgcatgatcgcctgcatacagggaggaattgcccatgttcgcaccaagtatccatgtggaatgcgtgagtttttttgaaccgtccaagggggaatggcgggaggagcgcgtcaagggtctggcggaagaggagtcttcgcgctgcccggacgacgaggatgaggactttctttccttctgccgccgctcgctgctgtaattgccggccagccttgatggggccgatgcgaaacaggcagcggcgttacgggggggagaagttatttctcgaaacaaccatattttttgaggcgaatcccagccgagccacgatgacggcgcaatatttgcttgctttcgagaaccgggccgacgcgttgtttgccgcgcggccggtcccggccagaaactcggaggcttcatgaaacgcctgctgtgcatcctggctttgctggcctttgccttcacggccgccggctgcccgccgccgcgccggcccctgccgccgcccggtccgggagcctatcagcccggcccctaccaccccgcgcccggtcccggaggatacccgcccggccccggtcaggcaccgtatcaacccggccccggcccttacggccatccaggcggttatccgcccgcgccttaagcttttgaacgcaacaacgccggctcctcgaaaggggccggcgttttgttttccacccgggcgtggcctttctacttcacgccgatgggcgcgccggaagcaaacgccggctcatgcagcggcagcaggatgtgggccgccttcttgacgcggaccatgatgtcgtaggccgcgtaaggattgacgcaggtgccgggcgggatgacgtccatctctcgggccgttacggccttgggcggaaagaaattctcgttgatgacgcaaaagccggtgatgacggcctggccggccggggtgtccacaaagaccgacatgccgccttcggtgtgggccggggtgtggaccatgcgcaggccgggcaggatctccgtgtcgccggtgatcgcctgcatctggccggaatcgatgacgtcttccacgtattcggcgttgtagcgaaagtccaggggatgcgggtcgctcacgtgggccagctcccgttcatgggcgtagatgaccgcgttttccagataggcgtcgttttcgcagtggtcgttgtgcaggtgggtgtggatgaccacgtcgatgtcggcaggggtcagaccgtactgggccaggcccgattccagggtgtggattgtgccgccaagggccgcctcgcgggcggcggactgcaccgggcgtatctcgccggtgtccaccagcaccttcttgccgccgccttccagataccagccgtagatggggatggtgtaaggcgtgccgtagtcgaactggtaggtcatcatgcccttgtcgaattccttggagccaaggacaatgggatggatcacgtacttgcccacagtaaataaacctccgctgcgcgcgcaaaagttccccgggacgtgcggcatcccggcgcgtcagtcgaccgcccgcggcaaaggtaagcagtcggcggcgacgcggcaagggggaggcgcccggcggcgagttgacggcggcggcaaagacggacacaacgcccatggcgatgcgcgccgccagacgccccaacaggcgggcgatttgaagcgctccacttgaaaatgcagccgtattttcaagaaaatgtcttggaattttggccgttgccgacaaatgaaccggtaggcttttcgagcgcgcgtctagtgtcgcgtcccttaaaaaatatgagagtattttttaagaaaaataaatggttttagcttgttgactacaaaacaccatatgcgcttttcgcggacgcgacactagccgcgacggcgcgcccgccaggccttgccgcctggtgcgtttctccgcgcgatatggcggtccgcgcccgcaaaccgacgcccacacgttcaggtgacccctctatgatgtattccattcagattttgcggatcatcggcatgttgatgatcgtctatatccatgtcggcgtctacatgacgctggtgaacaacgtcggcgattccctctttcacgtcatccccgacgcgtacatgtgcaaggccttcatctttttcagcatctccggctttatcatggcctttctcatcgacatcggctaccgcaactttctggtgcggcgcatcctgcgcgtctatccgaccttcctcatcgcctgcggcctggccatcgccttgcgctatctgctttttgaccagctgccgggcaaggacatgttcctggccatgacgcttttgcccgtaggcttcgtggattatcccctcaagatcgaatggacgctgatttacgaagtctgctattatctcatcatcacgccctttgctttccccaagacgcgacgctacttcgtgccgtttctctttgtctggctcggcgtcatttgcatcgcctactacgcttcgggcatcacggccttttacgtgctgccgccctggaagcggctgttcgtctcctatgtcaacatctacttcatcaccggggccctggcctaccacgccgccaagcgcctgcggttcgactggtggccggcctatgtcctggccatcctggccagcgccgccgtcaccgtggccacttcggacgcctggaagcttgaaccctacaacatgaaacagttggccacctggagcctgtgcaccgccgtgacgctggtttccctggtcaagcttgaaaaccatttccaggccccctgggtgaaggccatcggccagtggggcgactacgcctacgccgtctacctgacccacgccctggtggttggggtctttttctcctggctggtctaccggtacggctggcagctcgacaaccgggcggcgtttcttgccgtgggcctgattctcgtcgtgggctatggcctgggccggctcgacgccgccgtgcacggctatttcaagcggaaattcgcctgatgctctccggcgggaaggtcagatgccgcattacttcgtttcggatggcctctgggctgcggttctcgtgacgctgggcggcgggaaggcgtgatgtccgacaatcttgcgccgtatgtcctagatgatgcggttttcgtgacgccgtgcggtgggacgagctgatgccggcttcccgttcgtttttcgaccgggcggctaacgtggcgctgattgccgccacggtgttggccctgggctgggccggtcgtgaggtggccgttgatcttcggctcacccgccttcaggaacaggcggcccggcgtgtgccgcattttcccgacgcggcctcgcgcacggcgtttactgacgccgccggccgcgacaaggccctgtgcgcggcgtttcttggccgcaagcccctggtcgtcctgaccatcggccaatccaacatcgccaattcggctctggggcagttcacccccagccaccgcctcggaaactatttcgagggatcgtgctatatcgcggccaatccgcttctcggcacgtcgggcgagcgggcggcggcggtgcttgatttagccgacgcggccctggatgcgggactctacgacagcgcgcttgtcgtgccgctggcggtgcagggttcgtcggtgtggaactgggcgcggcacggcgacttgcggcccatgctcgaaagcgccctgcgccgcctgaacgggctggggatcaagcccaatcttgtcctctaccatcagggcgaggccgattgtctggtggggatggaagggaggctttatgccgaggccctggacaatatcatcggtgatttgcggcgcatgggcgttgccgcgccggtggtggtctcgcaagtcagccgcttcaaggcgttggactgcccggacgccgatcccggggcttgttcgcgcatctgtccggacatccgccaggcccaggccggggcggccgacgcctcgcgcggcgtcttcgccggcccggacacggacatggccgtagccgagcggttcgacggctaccacatgaccgacgacggccgccgccgcttcgccgccatgctgctggaaaccgtgcgcgccctgccccaaacgccctagcgtcgcgtcctcgaaaagcgcctcggacattccgcagacaacagacgaaaaccacttattttcttaaaaaatactctcgtattttttaaggggcgcgacacgagctctcccccggcgaagccaccccctttccccattcggggggtccgggggcctcaggcccccagccgccggaggcatcttcctctttattttcttcgtcttatcatcttcctacgaacaaaatcggtaagcatccgggcttcctcgacgcgtagcagcgaggccacgctcatgtaggctatggcccacaggatgatgaggatgagcgagaggtaggggcggtcggccgtggcgtgggcgccgaagccgacgccgatgcttaagattgtgccgatgaaggtggtgcggcccaggcgcagccagccggggccgagctttttgcgcaggaccaggcccagggcggcgatgttgacccaggacgagatggaggtggccagggccaatccgacatggccggtaggtcccatgagggccaggccggcgatgacgtagaccaccaggcacacggcggccacgatggccggggtgcgggtgtcggacagggcgaaataggcggaatacagcggccgcacgcaggcaaaggcgggcaggcccacgccgtaggccaccagcgccccggcggtggcggcgatggctgcctcgccaaaggctccgcgtccgaaaagcacccgcaccatgggatcggccagggcaatgagcccggcggcggccggcaggcagatgaaaagggtcaggcgcagcgaggcgtttagggtatcgacgaattccccggtcttgccggccgaggcgagcttggccagcccgggcagggccaccgtgcccacggccacgccgaagacgcccaggggaaattgcaccagccggtcggcgtagtagaggtacgagatggagccggtgggcaggtaggaggcgagaagcgtccccagcacgatgttgagctggtagaccgccgcgccaaaggccgtgggcagcatgagcaggcccatgcgcagcacgcccttgtcgcgaagggaccatggaccgcgccaggtaaagccgaacttccgcagttgcggcagctgcatgtagacctgcccgataccgccgatgaccacgctccaggccagggtgtaggccggatcgaagccgaacagccaggccacgcccgcgccgaggatgatgatggtgttgagttcggatgtggccagggccggagccaggaaatggccgaaggaattgagcacgcccatgcacaaggccacggcggaaatctcgatgatgtaggggaagacgatgcgcgtgagatccacggtcagatcaaacagcgccggatcgtcggcaaagcccggggtgatgagtttggtgagcggccgggcgaagacaattgccaacgtggtcaggacgccgaggatgatgagcagccagaccatggccgaacgcggcatggaaaaggccttttcgtcgcccacctcctcgcgcagcttttgaaagaccggcacaaaggccatggtcatggaaccttcggcgaaaagccggcgcatcatgttgggcaggcgataggctacgtaaaaggcgtcggcggcaatgccggcccccagcacgtaggccaggatcatatcccggaaaaacccgagtatcctcgacaacaaggtcgcgcccccgacaatagaggcatccttggcaatctgtctgacgtgttgcgacatactattttgtggggaggaaacccctttttgaaaaaaggggtttcctccccacgcccctccttccccaaaaacttttaacggtggggtttcaccgtgtgtggcttctctcttggacttcctggctgtgggggcgtttttcgcggccggcagggtcttccctgccggccgcgaaaaacgcccccataatcagggggtccgggggggatgatcccccccgggaaagtattacttttgacacttcctgcaataggtggacgtgcggccggcgattttggcgtgggtcagcggcgcggcgcaggccgggcaggggtcgccggatttgccgtagacctggaaatggttctggaagccgccttccacgccgtccggggtgcggtagtcgcggatggtgctgccgccggcggcgatggccgccgcgatgacgttttggacggctttgaggaggcgttgccgttgggccggggtcaggtccttggccggcgtgtcgggccggatgcgggcggcgaagagcgattcgtcggcgtagatgttgccgatgccggcgatgacggtctgatcgagcagcgccgccttgatgcgggtggacttgcggccaagggcctcctcgaaggcttgcggcgtcatgtcccagggttcggggccaagggacgcgtggaaatcccaggcgctcagggcctcgggggtgagcacccgggccgtgccgaagcggcgcaggtcggcaaagaccagggtgttgccgtcggagagccggacgagcaaccgggcgcggtcgggatcgggagcgcccggcggcgcgatgtggaaacggccggtcatcttgagatgaaaggccaggacggccgggccgtcgcccgggacctgggggcgcgggccgagggtgagcagcagcagcttggcccggcggccgacggattggatggtccggcctacggccatggcggcgaaatcggcccggcgtttggggccggccagcaccttggcgtccgggacgtcgacgccgacgatgacgcggccgacaaggcccggagccagggctcgtgcgatggtttcgacttcgggaagttcgggcatggcggatgcgcctacgggcggttcaggccgccggccgggcggcgcgacggacggtttgccggagaggcaggcccggtggtgttgcggcggtacgacggcggcatggcgctacttggcggcgggcagggcgatggggatgtcgatggtcagggtttccccggcccggaagacggtaagcgacagcgttttgccgtccttgacggcctcgatggcggccttgtggagcacggataggttgtcggccgggtggccgccggcggcgacgacggcgtcgccgggcaggagtcccgccttggcggccggggaaccgggggccacggcggtgaccagcggcagggtggcggggttgccgggggcgggctggtcctgggtcagggtcatgccgagccggcttttctgggcggccgggcaggcgaagaagtagggcgcggcttcggcgtccggggcctcgccgccgcgccagggcatgaccagaacgaccttggccgagggatcaagcacggccaggcggcgggcgatgccccagccgttggccacatgcccggctccggcgaccacggccacgggccggccggacacggctcgggcatagagcgcccgggcggccatctgggtgtcccacagggactgcacggtaacgaaattttcaaagggatcgcggaccggcgcggcgtcccggggggccggcttggcggaggctttggccttggcgctggacgtggcggcgctcttggcggtcggcggcgcggcggcgtcgcccgatgcggccttggcctgggcagccgtcgcggtcttgggcaggctttcgggtttggcggccggcttggcgttcgcctgctcaggcttggcggtttcctggggcgcggccttgcgcatggccccgtgctgggcgaacagttcgcgcagttcttccacctgggcctgggccgggggcaggatggttccggggaggctggcgcgttcggccggggtcagggcgtccaggccctggcggccgaccttgcgggccaggcccttgggggcgtttagggcgtagaccgggagcttgtactcccgggcagcctgaaagatgggggcgtagagttcgaaatcaaagccccaggtggttttccagtcgagcctggccggcagttcggccagggggagcgtgccggcattgaaggcgtcgaggacgccttgataatcggccgggaccatttccaggccgatggccgggaaaacgccggcggcggccagccggcggatgacggcggcctgggcctgatggtcgcaggggttggggtgttcctcgcccagcaacagatagtcggctccggccagttcggcggcaaaggcggccggggccagggccgcgcccgtggcgtcgaccagactctcgggggcgaccgggggcatgcccggggcgcgtttcacgcagcccgcgccgataacggccagaccaagcaggccggccaggagaaaagcccccagggcgcgggaggttcccgcgcccctgggggccgtaggctcgaacggaaagtggactggcatggttatgccgggcgacgcatggacgcgcctagtcccacttgcgcttgtcttcgatgggccggatctggggcggcagggtgccgggggcgaccacggtgagcgccgggcgcagcttgatcttctcccggaacttgtggagcagatcttcctcgcgcttgaagttggaggcttcgatgaccagggtcatctcgtcgatgccgccggggttggtgacctcgatctgccagcgcttgatctcctcgaagcgggtgatgacctgctcgacctggtgcgggtagacgaacatgcccttgatgcgggcggtggtgtccacgcggccgacgatggagcccaggcgcggcgaggtgcgcccgcagggacagggcgcgcgctcgatgtaggacaggtcgccggtggccaggcggatcagcggataggtcttgttaaaggccgtgaccacgatttcgccgacttcaccgtccttgagcgggatgccggtgtcgggatggcagatctcgacaaaggcgcggttggcaatgtgcaggccggttttgtggaagcattcgtagccgatgcagcccacgtcggcggtgccgtagccctggcgcatgatgatgtcgaatttcttctccagattggcgcgcagcttttcggagaatttttcgccggtgacgaaggccacctccatgtagaggtccttgcgcaggttaagccccatctcctcgcccttctgggccaggtgcatgaggtagctcggggtgccgacgtagccggtggcccgcagcttctgcatgatctccaactgggtggcggagttgcccgggccggcgggaaccacggcgcagccgaggtttttaagcggctcctcaaacatgagaccggccggggtgagatggtaattgaaggtcacctggaccagatcgccggagcggaagccgcaggcgtaaaagccctcggtccagccccagtaatcgtcctcgcggtcctcgggatcgaagatcggtccgggggacagaaaaatacgccgcagttcgcccatgtccttggtcaaaagcccgccgagcctcggccccatggactgcaggaagatgagttccttcttcttcaggatggggatgtgcttgaggtcggtgagggtcttgaacttcgaagcctggaactgggctcggtcgaagcgcttcttgacgtcttcggagtagcggtaagcataggaaagcagatccttgatctggatctggtagtattggcggcgttccgattcgtcgagcacttcccggcgggaatagatgccttctgtgcgatccttgcgcgtcatgccgggtctcctttggcgcgaaatcccgtgatgggaaaaagagaatttctttagaccgatcttttggaaaaatcaagccgcccggaagggccttccggccagggcccgctggaccacggccagcagctcaaaccgggtgacgggcttggcgatgtagtcggtcataccggccaaaagtccctggcggcggtcttcgggcgtggccgagccggacaagcccacgacggggatgtcggcggcggcgccggactcgccccggcggatgcggcgagtggattccaggccgcacaggcccggcatggtgacgtccatcagcaccatatccacgggccggctgcccagaatgtcgaacaggccctcgcaggaatccacggaaatgggcacgtagccccggtcttccaggatgcggcgcaccagaagctgggccacggggtcgtcctcggcgtggacaatgaccgcgccgccgccgccggtggggtgagcggtctcgttcgtggtcggggttgggcattcgacgcagggccgtcgcaattcggcggtgaaggtgaacgtgctgccctggccgagctcgctttccacccgcagccggccgcccattttttccacgatgtcccgggctatgcccaggcccaggccggcctgggcgtagcgtttgcccagaaacggctcgccgatggcgaaatggtcgaagatggcttcctggcggtccggggcgatgccgatgccggtgtcgcgcacggtaaaaagcagtttggcggcgtcggaacgggcactttgggtcggggccatggtcacggccacgtccaggccgccgtgttcggtatatttgagcgcgttgtggatgagattgagcagcacctggcgcagccgctgggggtcgcccacgagctggaccggcacgtcgtcggccacggcggcctgaaaggccagcccccgcgaggccgcgtcctcggcgcacatggcgaaaagctcggacaacatccggcgcggctcaaagagttcctcggccagcaccagccggcccgaggcgatgccgtttaagtcgagcagggcgttaatgacgcccaggagctggttggaggcgttcatggccagttcgaggaactggcgacgacggccgtctccctcgctttggagaagcaggctcaacatgcccatgatgccgtttaggggcgtgcgcagttcatggctcatgttggccaggaactgttccttggccgcgccggcccgggcggccgagccggcgaaggcggcgaactcgcggtagaaatgctcaatgaggccgcggcgctggggcagcaggcagggcaggacgtgcaaggcggcgtcggcggcccggctgcggccgaaaagcgcctgacggtcggccgggttggtgaaatagggacccacgatcagttcccccggccgaccgtcgcgcaggaccaggggaaagcgctccacggccagtcccagggggcagacggattttcgcgtatgggcctcgtccaggggcaggtccggggccagccagggacatggtccgcgctcggggaattcccggtgcaaaatggcatgggcttcggccccggggtcgggccatacaggcatcccgggattggtgttgacggcaaccggaacgcccagaagcccggttaagggatcaagcagccgcttgagcgaacggggcgcttcggcgcttggcacatcttttaccatgctagaagtcttagccgcttcctccgggccggtcaatcggccgcgtcgggattgtcgtctccctggccgctctcgtcaggaaagccggatgggccggcgtccatggattcggggaagtcggccggcggcgggggcgggcagacgtcgcggccgccgtggcgggcaaagaccagaaaaccggtgtgggccaccatgcggtcctctggccgaagacgctcgggcacgggcttgtagcgccgcaccaggatctcaagcacctccacgtcctcgaagggcgagtcttccaaagcccagagcagttcgctgatctggttggtggtgggcaggagaaaccccaccggcgcgcccggccgcactaccgccgctgcctggggcaggtagtcccagggcgtgcgcacgtcgagaaacagcgcgtcggcgtcggtggggtcgctggccgggtcgcccttgaccacggagtcggggtagaagccctcggcgatgtcgtggttatggcgtgacacgcggtgggacaggcccacggcgtcgaggttttcgccggagagggcatagaattcgggtcgtttttcaaaggtgtagacccggcccgtatcgcccacgtgccaggccagggccgtggtgaggccgcccgagccgctgcctgactccaccacgcggatgcccggaccgatgccgagctttaagatcacgtagccgatttctttgggatacatgatctgggtggagcgcttgacgcccttgatgagatcgtgggtggtgggccgcaggatgcgaaagacgtggccgatgtgggtggccaccgcgccgccgctgccggcccgggccacttcgctgaaccggatcatgccttcctgggtgtgcagcaccgtgtcctggtcgaaacgccgcagatatcgcttgcccttgggagagaccagaagtatcaaatcgccctgtttcacgctgtcaccccgggttgtttgttgggtcgaggcccttgaccatggcggggcgcgcctgtcaagtgtgcgagacggcaaaaaggagcgcgccacggaacctttacggcatgtttttggcccggtcggctcagggaggctcggcgtttcgctgggcctggatctgcttggcgcgcgcatttgctcgtttgattgcctctactgcgaggccggcgtcaccgaggccctgaccaccgcgcgcaagccctatgttccggcccgccgcctgctggacgaactggccgcctggaaggcggccggccatgccccgcccgatgtcgtgaccctgggcgggcttggcgaaccgtgtctgaacagcgaactcggggccgtcattgccggggccaaggaattgtttccggacttgcccgtggccgtgctgaccaattcgagcctgatggccgatccagacgtgcgtcttgaactcgcccaggccgatatcgtgctgccgtccatggacacgctggtcccggccgagtaccatcgcctgaaccgtccccacgccgccgtgggccttacggccatccgtcagggcctgctcgattttcgagccgcctacgacggcaagatctttctcgaagtgctgcttttggccgggataaacgattcggttgaaaacagcgagcttttgcagggcttttgccgggaactcgcgccggaccgggtggatgtggtcaccctgtcgcgccccggagcccatccgggctgccaggccgcttcggccgaggccctggcccggtttagggccgccctgggcggcttcgcccaggatgccgccgcgccgcgtcgggccgagggccatggccccgccgccctggccgggccgcagctcgaagccctggccgggcgcatcgccgcctcggtggccagacgcccccagaccgaggccggtctggccgcgggtcttgacgtgcccgccgcccatgtccggctggccctggccgcccttgtccgggccaaggccgtgcgcgagcggcgcgaaggcgacgcggttttttattccggcctggccggataaacaaaattttgcctgggcaagcctgcccaggcagggagtttcatggaaatgagcagagggaagaaacgcaagcagaaaatgttcatcagcgtgctgcccggcgaacaggtcgaggtggccgtggccgaggacggtcagctgctggaatattacgtcgagatggtccatcaggccaaaacgcggggccacatctacaaaggcaagatccacaacatcgatcccgccttgcaggccgcgttcatcaattacggggccgagcgcaacggctttttgcagatcgacgaggtacaccccgagtactaccagatcgtgcaggccggcggcgaccgccgtcccaagtatccgcccatccagaaggcgctgaaaaaaaatcaggagctccttgtccaggtcgtcaaggaacccacgggccacaagggggcgtttctcaccacctatctgtccctgccgggccgctatttcgtgctgaccccgggccgggagcagcggggcgtgtcgcgcaagatcgaggacgaggccgaacgcaagcgcctcaaggaagtcatttccggcctcaagctcgacgagggcctgggccttattgtccgcaccgccgccttgtcccagtccaagacgtcgctggagcgcgatctttcgtatctcaagcgcctgtggaaggaagtgcgccaacgcggcaccacggccgagacgccaagcctcatttatcaggaactcgacctgtcctcccgggccgtgcgcgattacctgaccgacgacgtgggcgaaatctgggtggacgaacccgagacggccaagcgcgtgtcggaaatggccaccctggtctatccgcgccgtccgggcatcgtcaaacagcatcccgacgtggacgtgcccttgtgggaccgcttcaacctgcgcaagcagatcgagcagctctatggccgcgaggtcaccttgcccagcggcggcgtgctggtctttgaccacgccgaggcgctcaccgccgtggacatcaactccggcaagatcggcggcgaatcgaatttccgcgagatggcgctcaagaccaacatcgaggcctccgaggaagtggcgcgtcagttgcggctgcgcgacatcggcggccaggtggtcatcgatttcattgagatgaaggaccgaaagcacgtggccgaggtggaaaagaccctgcgcgccgcctttaaaaacgaccgcgcccgtaccgacgtcggccgcatttcgcgctttggcctgctcgaaatcgtgcgccagcgcctgggatcctcagccctgtccatcacttccgagccctgcccgtgctgcaacggctcgggccagcggcgcaaccacgagtggcaggcgctgacggtgctgaaagacatctaccgccagctgcgcaaggattcgagccaggagacggtgacggccaaggtctccgaggaactgtcccgctatctcctcaaccataagcgcgcccgactctcggccatggaagaggagttcaagaaaaagatcgtcataaacgccctgtgacgccatggccggccgggtcctgctccatatctgttgcggcccgtgcgccatcgcgccgctagcgcgtctgaccgaggccggcctggaggttgtcgggcttttcgccaacgacaacatccagccggctgccgaatggctgcgccgccgcgacggcgcggcccaggtcgcggcccggttcggcgttggcctgcgcgttgacgcctacgatcccctgcctcacatgcgccgctccctggctgatccggccgggcgctgtcgtccttgctgggaagaacgcctggcccgggcggccgttgttgcccgtgagcaaggctgcgacgccttcaccagttcgctgttgtacagccgctaccaggatcacgccgccatcgccgccctggggcgggcagccggcgaggcggccggcgtggcctttcattacgccgactaccgcacccactgggacgagggcgtggccctgtccaaggactggggcgtctatcgccagccgtactgcggctgcgtgctcagcgaactcgaccgctacgccaagaagctgcgccgtccgccggtcatcgacggttaatgtcgcgtctcttaaaaaatacaactgtatttttaaggaaaaccaaaggttttcgtctgctgtctgtggcgtgatccatgtgctatacttggacgcgacactaagccgtaccacggcggctcccgccggggcatggccatgatctcctgcgcccatccggggcgagcgccggctccgcctaggatttctcggctcaccgctgttttcacgacatgccgacacatttctcctccgtcatcaagcgtttttgccgggctcggcgtggtcgtcggccgttgttcccctggccgcgagggcttataagaccccttgcagacgcgccgcattgatccggctggttccattttgtctggaacgataagctcaaaaatcaattacaaatggactcgttgtcgagccttccaccccgagcctttggaaaaaacatgcaccacgccttgcttttggccgtagccgctggcttggacctgattttcggcgatcctcgccaactgccgcatccggtacgggccatcggctggtgctacgcccgactggacgccctggccgaccggcttggccagcgcagccggcttttcggcgcgctgtctgtggtcgccgtggccggcggcagcgccttgattgtggcggtggctggcgcgctgcccgtcgtgggcacggtgttggccgtctatttcgcctatgccggcttggccctgggcagccttttggccgaaggacgacgggcggcacgcttcttgattgccggggatacggaagctgcccgcatggccgttggcgggctggtcagccgcgacgtggccggcctggacgccccggagttgtggcgagctctggccgagtccgtggcggagaacgccaacgacggatttgtggccccctttttctggctggccatcaccggtccggccggactgtgggcctacaaggcggtgtccacggccgactccatgtggggctaccgcaccccgcgccacgagcggctcggctggttcggggcccgggccgacgacgtcctggcctggctgccggcccggctgaccgtggccgccctgtggctggcggcgcggctcatgggcgcggggaggagcgttcgcctgggcgacatcgccagggacgcggccacaagcggcagccccaacgccggctggcccatggctgctgcggcctggctatgcggcggcagcatgggcggccagacgcgctaccatggagtgctggtcgataagccacggctggggccatcggaccgtccttgggatgcggcccgttacgaattgctgagcgccatggtattgtttgcggggtgtattgttgcagtgggaacagttgccttgtgtagcataggggtgtggtcttttgtgtgattgttgccgtcgagatgagtcgtctgatctttatttgtccagtctgtaatatcgatggcggcacaaaaaaatgattttttgttgacgagattctatttttggtggtaggtgataaagtacgattttttcaggagggcagactcatggcttttgaaggtaccgtcaagtggtttagtgacaaaaaaggctatggattcatcatgcgcgaaggcgaagatgatgtctttgtccattactcttccattgaaggggatggcttccgcacgcttcgcgaaggtgagcaagtaacgtttgagattcttcagggcgaacgtggccccaaagcctctaacgtggtgcgtcccgcctagctgcattgtcccattgcacaagacaaagcccccgtcggacctctccggcgggggctttgtgacgtttgtgcgccaaaaggggcggcgtgttacgcgcccagagccttggaacggtcccgggaggccactgcggcgtcgatgatggccgcccgcaccgcctggcggtccaggtgcatgagcgcctcgatagtggtgccggccggcgaagtcaccatttcgcgcaggatgctcggatggatgttcgtctccgccgccagcttggacgtgccggcgaaaaggccgatgacgatgtcggtggctttgtcgcgaggaaagcccatgagcacgccggactcgatcagcgcctccatgaagtggagcacgtaggccgggccggagccggcaagccccgtgaaggcgtcgaagaacttctcttccagcacataggtgcgtcccagggcggcgaaaagcgtctcgacaaaggccttgcgttcggcgtccagggccggatcgtccaggcacagggcgaactggcccgcgccgaccagggccggggtgttgggcatcacccgcaccaccggacacttgccggccgagagttcacgcagcttctccacagtgaccccggccacgatggacacgagcaccgtttccggaccaagggccggggccagttcggccatggccgcggccagatactgcggcttgacgcacaggatcagatagtcgctgccggccgccagatcttcgggagtcgcggctggcttggccagcttgtcggcggccagggccgccaccttggcggcgtccacgtcgtaggccagggccgagacgtcgggaacggcggccagacctttgatgatggccgcgcccatgttgcccgcgccgagaaatccgatgacggcggccatggccctagcccaccatttccagggcgctgaagaagtagccggtctcgacggcggccgtctccggagcgtcggagccgtggaccgagttcttctcgatgtccagggcgtagcatttgcggatggtgccttcctcggcgttggccgggttggtggcgcccatgagcttgcggtacttggcgatggcgtcgtcgccttccaggatggacacgaccaccgggccggaggtcatgaaatcgaccaggctgcggaaaaacggacgttccttatgcacggcgtaaaagccctcggcctcggcggtggacagctggatcatcttcatggccacgaccttaagcccggagtcctggatcattttgaggatggcgccggacagattgcgctcaacggcgtcgggtttgatgatggaaagcgtgcgttccatggatgtgctccttgatggttttagcttcgggacaaagcccggcgtgcggcccttaccgcgaatccgtcgccaaggcaaatgccgcgagcggggagaggcaggaagggagggggatgcctccggcggctgggggcctgaggcccccagaccccccaactggagaaaggtttaaaggggttttgacgaggatgggctgaggcccggccccccggttatttatcgatgaagagcggcaggggagttatacgcggccggcgatggcgcgcagcacggcttcccggtccaccatgccgcgaagcttgccgtcgtcgtcggtgaccaccaggcgcttcacgccgtggacgatcattttttgcaatacgtcggtcagcgccgcgtcctcggccacgctgtagaccgtggtttgcatggcctcacccgccgtgcccaccggacaaacgccggcggcctcgtcgtcctttttcccgaaaagcgcctgcaggatgcccggacgcttggacgggccgcaacgggccagcagatcgccgtcgtggacgatgccggccaccttgccggcggcgtccaggaccaccacccgccgcagcggcgaagccaccaatcgggacgccacgtcaagcagcgattcgtcgggccgggccgtgggcacgtcggtgatgagcacgtcccgggcttgctgcatgagcccggccgtgaaacgcggcatggcctcggtcgccccgaccggcaccttggccgctgcccgtaaaatatccgtacggctgacgatgccgatcagctccccagcctcgtccaccaccggcaaccgcttgaggcccttttttaccatgcgctcggacgcttcccgcaggctcgtgcgctcgccgatggtctcggccggcgcggtcatgacttccttgacggtgtgcccggacagggccgccgccgcctcttcccgggcgtcggccggcaacagcccgaacagcgacaaccgggccgacagcccgccgcgcgtgagcagatcgccgcccgtgaccacgcccagaaccttgcgcccggcgtccaccaccggcacggccttgacgtggcgggccaccagcaggtccaccacctcgccaaggtccgtgtccggccccaccgaggccacgtccgccgccatgacgtcgcgcacccgcactggacaccggaacagggccgccatgcgctggcgcgtcaccacgccgcccttggcaagcttttcgattcggggcagcaaggcgtcgatgcgctcgggccggtcggcgatctccaccaccatgggcaaatcttccgacaaccgcaaaattttcgccgtatgcaccagactgccggctccaaagcccagcacgccgcgaaacaccgtggccccggccgccccgtgccgccgggcttcctccaccaccagctcataagccggccggccgtccacccgatccgactcgccgcagtacacccgcaccaaatcgatttccatccagtccgacatagatgctccatggtaagcaagcgggctctgcccgcgcccgccggggggggataatcccccccggacccccttgcctgggtgggctgtcgcgacgcgggaagcccgcgtcgcgacagcccacccaatcaacggaatccagaggccatgatcacgccgacgacgttaaaatacgtgttctttctccaccacttcggccccgcttcggggccgagggccggttggggtcgggattttggccgggaataacggcgcgccagcgccgagattcccggccaaaatcccgaccccatcttcgcgaagcgccgtcacccaccgtctgccccctcacccgcctgccaacccaggctgggggtccggggggctaagccccccggcgggtgcgggcagagcccgctcttcctcttgctctccctcgtccgctctcccgccaccacgcctttcttaccactcccactaccatgcccatcccacccgtcctgtcccagctatatcagccttcccagcgccaggccggcgaacagggcggcgaagccgaggatggtctggaagccgaggttggcgagaagggcgaggtagcggtggtcttcgagcaggccgccgctttcgaagatgaaggtggagaaggtggtgaacgcgcccatgaagccggtgagcagcacggcgcgcgcttcggtgcgcagcaacatgcgttccgcgccggcttcccagaccaggccgaagaggaagcagccgaggatattgaccacggccgtgccccaggggaaatcccggcccaggacgtcgtagaccagtcccgagagccagtagcgggccagggtgccggcggctccggccagggcgataaatcccagtttttcgagcatgtcgccactccgggggcgggcggcgggggtacgcgcgtccgggtgatttcgtgttttttcttacgcctgggcgcaaaaagcgtaaagggcgcggttgacgaaaccaatcccatcgttatggtatggatttgtcacgggtctttgaaaaaacggggttcgccccttttcgccaaccgccttttacggcatacactggcgttgcgacgccggccgcgtgccgatgcaacggaggtcaacatgtgggaatatacggataaagtaagggatcattttctcaatccgagaaatgtcggcagcctcgacgacgccaacgcggtgggcgaggtgggatcgcttgcctgcggcgacgcgctcaagctttttctcaagatcagcgatgccggcgtcattgaggacgcgagctttcagaccttcggctgcgcttcggccattgcctccagttcggttttgaccgagctgctcaagggcaagaccatcgaggaagccaaggcgctgactaacaaggacatcgccgagttcctgggcgggctgcccaaggaaaagatgcactgctcggtcatgggccaggaggccctggaagcggccctggccaattatctgggcgagaaggccccggagcacgagcccgaaggggaactcgtgtgcaagtgtttcggcgtctacgacggccagttgcgccgggccatccgcgaaaacaagctgaccacggtcgaggagatcacggactacaccaaggccggcggcggctgcggcgattgtctggaaaagctggctgccatcctggccgacgagcttgggcaggccgccaagaagccgctggtcgagctggaagtcaagcgccccatgaccaaccttgagcgcatgaagctcgtgaccaaggtcatggaggaggagattcgccccaacctcaagaaggacggcggcgacatcgaactggtggacatcgacggccagacggtcttcgtgtcgttgcgcggggcctgcaagggctgcccgagcagcaacgtgaccttgaccgaattcgtgcaaaagcggctccaggaactggtcgaacccggcatcacggtcaaggaggcgcggtaatgaacccggtcgtctatctcgacaacaacgccaccacccgggtcgccccggaagtggcggaggtcatgctgccctatctgacggaattctacggcaacccctccagcatgcattcctttggcggccaggtcggcctgcagctcaaaaaggctcgggccgacgtcgcctcggtcctgggctgcgaccccctggagctgattttcacctcctgcggttcggagtcggacaacaccgccatcttaagcgccctggccgcccagcccgagaaaaagcacctcgtcaccacccgggtggagcatccggccatcttgagcctggccaagcatctggaagaaaagggctacgaggtcacctatctcggcgttgacgacaagggcaacctggatctggacgagttggccggcgccgtccgcaaggacacggccatcgtgtccgtcatgtacgccaacaacgaaaccggcgtcattttccccatcccggagatcgccgccctgtgcaaggccaagggtgtgctgttccataccgacgcggtccaggccgtgggcaagatcgacatcgatctgtccaagctgcccgtggacatgctgtcgttgtccggccacaagctccatgcgcccaagggcgtgggcgtgctgtacgtgcgcaagggaaccccgtttcggccgtttctcatcggcggccaccaggagcgcggccgccgggccggcaccgaaaacaccgccggtatcatcgccctggccgcggccatgaccctggccaaggcgcacatggccgaggaaaatacccgggtgaaagcgctgcgcgaccgcctcgaagccggcatcctggccgccgtgccccacagccagataaacggcgacacggcccaccggctgcccaacaccacgagcatcgcgttcaagttcgtcgaaggcgaagccattctcctcatgctcgaccagtacggcatcagcgccagctccggctcggcctgcacctcgggcagcctcgaaccctcccacgtgctgcgggccatgggcgtgccgttcacctacgcccacggctccatccggttcagcctgtcgcggtataccaccgacgccgacatcgatctcgtcctcgacaagctgcccggcatcatcgaaaccctgcggcgcatgtcgccgttcagcgaggaagaagccgccaagccggcgtgcacctgctgatagggcgcttgctgggacgctgccctggacccgccgggggactcagtcccccggacccccggcatgggtggggtaggcgggtgggaggatggacggcggcgtcgcgcgaagatggggtcgggattttggccgggaatctcggcgcgggagcgccgttattcccggccaaaatcccgaccccaaccggccctcggccccgaggcggggccgaattggtggagaaagagtttttaaaaaacgttgtcggcgtgattatcgtctcgtatccctttgattgggtggcgcgatggcggcgcgggcttcccgcgtcgccatcgcgccacccaggcaagggggtccgggggggattatcccccccggcgggtccgggcagagcccggttaacgggagtggccatgcgaattgcaaacaatatgctggagttggtgggcaaaacgcccatggtgtggttgacccggatggccgaaggctgttcggcccgggtggcggccaagctggagtcgtttaatccctgttcgtcggtcaaggaccgcatcggcgtggccatgatcgaggcggccgagcgggaaggcaagatcggtccgggagcggtcatcgtggagccgacctcgggcaacaccggcatcggcctggcctttatgtgcgccgtgcgcggctatacgctcattttgaccatgccggagtccatgagcctggagcggcgcacgctgctgaaaggctttggggcgcggctggtgctgaccccggcggccaagggcatgtccggggcggtggagcgggccagggagctggtggccgagatgcctggggcgttcatgcccatgcagttcgccaatccggccaacccggaggtccacgccctgaccaccgggccggagatctgggacgacaccgacgggctggtggatattttcgtggccggggtcggtacgggcggcacggtgaccggcgtcgggcggtcgctcaaggccagaaagccggggcttaaggccatcgccgtggagccggcggccagtccggtgctgtccggcggcaaggccggcccccacgccatccagggcattggcgcgggtttcgtgcctgaggtgctggaccgcggcgtggtggacgaggtggtgaccgtgtctaatgaggacgccctggccacggcccgacgtcttttgcgcgaggaaggcattttgtgcggcatttcttccggggccaatgcctatgccgccttggaactcgcccgccggccggaaaacgccggcaaggtgatagtttttattgtctgcgacacgggtgagcgctatctctccacgccgcttttcagcgagggagtctgatgtccgacgccaaattcccgttgccacggccgcgccgacgcacgccggtggagtgggtgaccgaaatgttgtgcgaggaagcttcctacgagaaggtgtaccatcgcccgctccatgacgaacccatgccctcggtgccggtgctggaagaggtcatggaacgcctgcgcggcatcctgtttccgggctatttcggccattccgacgtctcgccggagaacatgcgctttcacatcggcgccagcctcgacgcggtgcatcggctcctggtcgatcaggtgcgccgggggcattgttttttttgcgagatagaccgggcaggcacctgccaggactgccaggagcgggccgaaaagttggtcggcgatttcctcatgcgtctgcccgacatccgcgaggccctggccgaggacgcccaggccgcctttgagggcgacccggcctcgcgttcgcccggcgagaccatcttctgctatccgagcctgacggcgctcacgcatcaccgggtggcccacgagctgcacaagctcggcgtggacctcattccgcgcatcatctccgagatggcccattcccgcaccggcatcgacatccaccccggggccaccatcgggcggcggttttttattgaccacggcaccggcacggtcatcggcgagacctgcatcatcggcgacaacgtgcggctgtatcagggcgtgaccctgggggccaaaagcttccccaaggacgaggaagggatgctggtcaagggcatcgctcgccatcccatcgtggaagacgacgtggtggtgtattccggggccacggtgctggggcgcatcaccatcggcaagggggcggtcgtcggcggcaacgtctgggtcgttgacgacgtgccggccggggcgcgcatcgcccagcaaggctcgggcggggtgatcatccgcgacggtgcggggatttagcttcgcgtctcttgaaaaatacgagagtatttttcaagagaaatttataatttcagtctgttgcctgcgaaaagccataggcgttttccgtggacgcgactgcgcttcgccactatagtggttgcagcaaactcagaaacgaacctgattgggccggcgaaacgcgacaatcgcgcgtacacgccgggaacgcgggttcccggggagggatgatgcgattgttgcttgtggcgctggccttgtgcgcgctggccggctgcgccgaaaagtccggttccaagtcgtttatcggcatcgacgcctatcaggaagaaagccgccgctggaaacagggcgaggacggcgacatgcggtttggccgctattccacccaccgttatgccgccacccagcacggcgtggattattcgccgaccacgagtgcctggggaaaaacctactattaagccaagtggttataattcgaaagcccggccgcgacagacgtcgcggccgggctttcgccatttgcagcggaaaaactagtcggcgacgatcatgacgctggaggccttgaccatggccttgaccttggcgccagccttaagtcccatgttctcggcggattccttggtgatgaccgaaacgatttcgacgccgggggcggcttcgatgacgacttcggcgttgaccatgccgatggtgactttcttcacggtgccggggatgagattgcgggcgctgactttcatgatggtactcctggcctcggggccgtcttgaggcggggtcgggaaggcctcgccgttgcgttccgtgaggcaagagataatacgggatttactcacacgcaaattaattttttcgtgttagttatgttattattaacacattaaattacagtattttagcattagttgagtcacgctaatgaattttgcgagattcttgatttgaaagatatgattttcgcttaactccattattttagatagttactgcaaaaattgtaaaattctcgccggaaaatgttacgagaacatcagatgcgatgcaggcgcggggatgggacatttcgccttggccgccctgtccctgggcagtggtggcgggacaggcggtttgggacagcggtgcaggaccgggcggtgcaggaccgggcggtgcaggaccgggcggtgcaggaccgggcggtgcaggaccgggcggtgcaggaccgggcgtgcgcccctgcttggggcgcacgcccattgatttacttggcggcgaagtccagccgcaccaccaccgtcgggtcgagcacctggaaggtgaaggattccaggaagaacagcgcgaccttttcggtgtcgtgggaggcgtagccgatggcgatgtcgccgccaagggtcatctccaggtcgccgccccgggtggagagcaggtaagcttcctcaatgaacgggctgacgatgacctggccgccaagcatggtttccaggtactgcgacaggggatagccccgcacatggcccgacagggccacccacagctccgggccgaccaccagggcgtaggggccttccactgaggttttgcgtagggcggtcagcgccttggagactttttcggcgatgtcctcggggttggaggagacctgcagccttgtctggctggagacttccgacaggcccttgatgccggccggagcaaagccgtggtagagggcctcttcctcgaaccgggccagtttttcggccgcctcgtccagggcggccagatcgatgtccttgccgccccgggcggcgttgtcgatctcggcgatgtccagggtaaagggcactttcacttcgaccagcggtttgacctgatgcaggccgtaggtgatgcccgagaccgactgggtcttggcgtattcgatgcgccccaggggcacggcggcgtattcccagccaagcggcccggccacgtccacgacgcggcggcccgagagcatggtggtcagcgtctggcgggcgcggctgtccacggcctgccaggcggcggcggttacgggggcgagatcgcgtttgagaatatccatggcgtctcccgtgggttagcggttgcccttgaggctgccgatgccaagcgagccggagccggccgggctttggggggcgttcgccccgccttcggcggcgtcttccagggcggtgatgtcgccggtggtgaacaggtaggtgcgcatgaccgcgtcccagcccggcatggtgcggcgcagccattccaggcccatgatggcgtgctccatctcctcgtcgcggttgtgggccatgatggccttgatctgcggatcggtggcggcgaccacccgctggtggtaccagttgatggcctcgatctcttccttgaggctggtcagcgcccggacgaaatcccggtccaggggcgaaagctcggcaacgggttcatgatactggtccatgcttcctccttggcgcgtcctgtcggacgtggacgggcgcgcgagattggggccagtatgccacaggccggcgggaatgcaacggcgcaggctggagaatcgcgtggcgttcaggcgtcgggcggggcgcatccgtgtctgccgacatgaggccgccatgcgccaagggcggtccgcttgggaccgggccgattctgtgccgggtagggctgggagggggaaatcaggccgaagcggcagggaaggccggcgcgccgggaaacccggaagtcccacggttcgcgccggcccaagaggggtcagatgagaatgaggtttttgatctcgtcgctatccgcttcgtcaggcggaaaatgcggcgcgagcaggccggccagggtgtccaggcaggcgatgagcgcctccttttgccggccggcggcgatgccccgggtgagcgccgccgtggccgcgtccagggcggcggcgtcgaggcggccgacaaggcccttgtcgggctggatgaagaccagccgctcgaagaccgagatgtagaccagcacggcgttgcgctgcttggtttcggtcaggccatgggtgaaaaacgcggcctgggcggcctgcttcgtttcggccagccgccgggccttggacacgaacaggcgtttgacgtccgggcaacgtttggccgcctcgaagccggccagggcaaagacgccgccaaacagcaggaacagccacaagttgcgcgtgccgaaagccaggcacagcaccagcccggcgcacagccccacgaccacggcgcaggccagctcggccttgggatagtcgtcgctggcctccaccaccatgggcacgatttcggccgaggtccgggcttcggccccggtcacggcggccacgatggcttcccggtcggccggggagaaaaacgcgttgacatacttgctcatgactccctcctaccagcttcccgacgagccgccgccgccaaaagaaccgccgccgccggaaaatccgccgccgcccgacgagccgcctccgccgccgacataaaagccgccgccccggcggccgctgccgccccggaacagatacgggcccaccagcccgagcaccgcgccgcccaggcacagcagggccagcatggccagagtcaggccgaagagggccccgcccaggggcagggccaggccgagcagcccggccctggccggggccggcagaccggacagcagggccgacaggatcatggccaggatgaaaagcccgaaaaaggcgttgtcgtcgtggcccgaggcgttgccgccgcctggcgcggcctggtactcgccgcgcgcgccctcgatgatggcggccacgccggcttcgatgccggcgtcgaaccggccggccttgaaggccggcacgatggcgtggtcgatgatgcgcccggtcagcgcgtcagtgagccggccttcaaggccgtagccgacctcgatgcgcaccttgcggtcgcccttgctgaccaagagcagcacgccgttgtccttgcccttttggccgatgccccaggcctgggccaccttgatggcgtagtcttccaggggttcgccctgcagcgacgggatggtcagcaccacaagctgggtggaatccgtgcgctggaaatcggccagggcggcgtccaggcggctgaccgcgtccttggagagcatcccggccgtgtcgttgactcggcccgtcaggcgcggcacgtccagggccagggcctggccggcgcacagggcaaaagcgagcagtacggcggccaggggagcatggtaaggcaggcgtaaggaaagcatccgcgataacctccgtcggctagaacttcaccttgggggcctgctgggccgcgtcgtcggccttgtagtattccttgggcgcgagatggagcagcatggagttggtcatggagttggggaaggtgcggatggagctgttgtagatctgcacggcctcgttgtagcgctggcgggctacgttgatgcggttttccgtgccttcgagctggtgctggagatcgcggaaattctggtcggccttgagctggggatagttttcggccacggccagaaggcgcgacagggcggactgcatctggccctgggcctgctggaaggcggccatggccttggggtcggccagggtttcgggggtgagcttgatttgggtggccttggcccgggcttcggtgacggcggtcagggtgtccttttcgtggctggcgtagcccttgaccgtttccacgaggttggggatgaggtccaggcgacgctgcaaggtggcttccacgttgccccaggcggctttgaccgcctcgtcgttggtctgcatttcgttgtagccgcagccggtgagcccgaaaagggcgacgacaagggccagggcggcaagcagtctattcattgggtgctcctttggaatcaagaaaagggatggcaatagttcgtctataccccgctcgggcggtgcaggcaaggcgtcggcggccggagacggttcggcaggttcacgccgcgcgcgagaccatggaacgagtcggcatgaaagcggtgttgttggtaaaaaagaagcgagaggccccgcgccggaaagcggcccgaggcccaactccagatgccccgggaaaggggcaaggctgggcggcggtcaggagacggagtcgccggccggcgcggaccgaaggcttagtcggcccggccccggccaagaatccgggccacgatgtcccgggaattggcttcggcctgcagatattcgtccagggacaggcccgcgcccagggccaccttcttgcggcggtcctggctgacgaagtcttccggggcatgggcgtcgttgtcgatgacgagcttggccccgaagcgtcgggccatggccgccacgtggccgttggtcaggctgtggcccttgcgggtggtgatttccagggccacgccgcgctcggcggccagctccgcctcttcgggcgtgatcatgccgggatgggccaggatgtcgcagccgccctcgatggcggccaggttcgtgcccgtttccaccggctccacgatggtctcgccgtgcaccaccacgagctgggctccggctgcccgggcgcgctccacaagctggggaatgagcggcggcggcacatgggtgatctccacgccgtaaagggccgtcagccccagaaaagcgccggtctcggccacgaaccggccgatgttggccaggatcaggtcgaggttggaatggtcggcgtggtcggtgagcgccacggccttgtagccggccttgacggcgcggcgcaccagctcggccggaatgagcacgccatcggaaaacgtggtgtgggtgtgcaggtcgatcatggttacatcttgtacttggtgtcgttggggtcgtacttttcgagcaattccgtccatttctccgagtcgtccgaggcgaactcgaccaccgaggcctccttggactccttggccacctgatcgatgacggcctcgttgaccaggatcggggccttggcccgcagggccagggccacggcgtcggacgggcggctgtcgatgcggcggatgccgccctccacttccacttcgacgttggcgtaatacgtgccttcggtaagctcggtcaggttgacgcagacaacgtgggcgtccagggcatggatcatgttgagcagcagatcgtgggtcatgggacgcggcagttccacgtcattaagcgccagggagatggccatggcttccatggccccgatccagatgggcacggcgtttttttcgtccaagtccttgaggatgagcaccgggacttgggactcctcgtccagggccagcccgaagactttcatttcaatcatgatcggcctccgcctccccgaccagggagtgctttttggcttggacgatgcgtacggcgacaaacctgccggcgtagtccgcccccgcgggcagcggcacgttgaccactcggccgccggggtcgcggccgcgccaagtcgctcccagcgtgccttcgcgccggctttccccctcgatgagcacgacttcccgccgtcccagccgggcggccagggaggcggccagccgttcgtccaaaagggcctggagttcggccagacgggccgatttctcctccggcaggatcttgggcgcaagcttctcggaagccgtccctggcctgtcagagtacatgaaggagaagccgctatcaaatcctaccttgcgcaccaattcgagggtggcctcgaagtcggcccgggtttcgcccggaaagcccacgatgaagtccgaggtcagggcgatgtccgggcaggcccggcgcagcttctcgaccagggtgagatacgcggcggtgtcgtagcgccggcccatgcggcgcagaatgtcgtcgctgcccgactgcaccggcagatgcagcgccgggcacagctggggcagggcggcgaagcgttcgatgacctcgtcgcttaggtccttgggatgcgaagtggtgaagcggatgcgctcaatgccgggcacggcggccacggcgtcgaggagcttggcgaagctcgcgccgtcgccggcgtcgtccaggccgtagctgttgacgttttggccaagcagcgtcacctcgcgcacgccgcgggaagcgaggctttggcattcggcgatgaccgagggcaggggacgcgatttctgccggccgcgcacaaagggcacgatgcagtaggcacaataattgtcgcagccctgcatgatggagacaaaggccttgggcggcagtttgtcgtcgggccaggactgatcgcgctcgggataggcttcggagaaatccagcagcgacagccgcagctgcggttcctcggccagccgggccagggcgcggggggcggcggcgatgccgtcggtgccgaaaacaagccgcaccatgggaaagcgccgccacaaggtcgtgccgagttgctgggcggtgcagccgccaacggcgatgaaggcgttgggattatgccggttgcggtcggcgatgcggccgatttcgctgacgactttctgttccggcttgtcgcgcaccgagcaggtgaaaaggataaaacactcggcctccgcttcgggagcctgggtgaagcctgccgcaataagggaacgggcaagccagtcgccgtcgccgacgttcatctggcagcccatggtggtgacgtggaatttcatggcgcaagagccataatgcacgccgggccggcggtaaagggggcgaggcgcggccgtcgttcgcgacgacccgcgtccggtcgcaacaggcttgccgatttctgccccgtgtgccacgacgataagaaccctggttctctcactcccgccgcagtggcggccaacctcaggacgtccggcaaaccgcgaggcgaaacatggaacaccgcatcgaatccgacagcatgggcgacatcgccgtcccggcggacaaactctggggcgcccagacccagcgcgccatcgaatatttcaccatcggcgaggaacggatgccccgggaactcatccgggcctacggcatcctcaaaaaggccgccgccacggtcaaccgcgaccagggccggctgccggccgaactggccgagatgatcgtgaccgcctgcgacgaaatcgtggcccatgcccacgacgccatgtttcccctgcgggtgtgggtctcgggcagcggcacccagttcaacatgaacgtcaacgaggttgtgtccaaccgctgctgccagctcgccggcacgccgctggggtccaaacagcccgtgcaccccaacgaccacgtgaacatggcccaatccaccaacgacaatttcccctcggccatgtacatggccgccgccatgggcacggtggagcggcttttgccctcggccatcaagctgcgcgacgtgctggccgccaaggccgaagtctggaaggacatcgtgaaaatcggccgcacccatctccaggatgccacgccgttgaccctggggcaggaattctccggctacgtgggactgctcagcgacgccgttcgccgcatcaaggcggcgcttggcgacgtttacgccctgccccttggcggcacggccgtgggcaccggcgtcaacgccgcgccgggctttgccgaggcggccatcgccgccatcgccacgctgaccggcctgccgtttacgccggccgccaacaagttcacggtccagggcagccacgacgcgctcatccacctgtccggggcgctcaagaccctggcggcggcgcttttcaagatcgccagcgacattcgcctcctggcctgcggcccccgggccgggctggccgaattgcgcctgccggccaacgaacccggctcctccatcatgccgggcaaggtcaatcccacccagtgcgaggccctgaccatggccgccgtccaggtcatggccaacgatctggccgtgaccctgggcggggcgggcggcattttggagatgaacgtctacaagccgcttattatccacaacgtcatgcaatcgatccggctgctggccgacgccatgaacaatttccgccgtttcgccgtggccgggctggagccggaccggcggcgcatcggcgagcttgtgggccgttcgcttatgctggtcacggcgttggccccggtcatcggctacgacaaggcggcggagatcgcccatcatgctgagcagcatgacctgacactgaaggaagcggccctggaccttggctacgtcacggccgaggagttcgaccgggtggtggtcccgtcacgcatgaccgggccgtacgtggcgcgggagtagtcctgccgttggcggggaactcctcgccaacggcagccctttccctttgtccattgcaggggtccggggggatcatccccccggcgggcgcgggcagagcccgctcttcctcttcccttattccctcattccccttccccttcacaacctgacgtcgtcgggatcgtgacgggcgtaggccgtgcgggcgcggtcgaaacttgtggtggcgtagcagtaggcgcagccgaacaggcagcggtcgtaggccccgatgtcgcggcttttggcgcagccacagcccgggcgctggccggggtcgcggtcgacggtcacggcgcgtccggtacgggcggcgatccagtcgccgtcgatgcagcgcgaggcgtcgatgccggcggcggcgtagtcggccggctggcagcaggtcgtaagcgtcagggaatgggcggcggccatatcgcgcaggtcgagcagcaggcgcaggcgttcggcctcgggaacgtcgaggggggcatagccttgcgcagcggcggcggccaggcgtttggcgattttgcggtagggttcgacgaagctgacgatgacgcggtcggtatgtccggccagggcggcggccagccgggcaaaggtgcggcgatgccagtcgggcggcgtggcggcggtcaaggcgatggggtcgtagcgccaaaccacccggccgggcagggcggcggcgaggtcgcggaaagcagggatggaaacgtccgggccggggcatttggggtccaggggccgggggttgtccaggagcgtgacgaggaagaaggcctcgtggcccatggtggcgagttcgggcagatgcgacagcatggggcgcgggtcgcgggtccagaaaacgatggcggcgacatcctcgggagccagtgacacgcggctgacctgggcggcgttgaaggggttggccacttcgcaaaagccggccctgatccggttcatgaaccagcggctgtagaaggccgggatgtccgtgcgccggctggcgcttatgagcacgcgcaggctccggcctgggtgagcagttcggcgaatacggcgtcagggagcagactgccgccggtggcccagaggaggtggacagccggacggccgagccgggccgggaagccggcccggcgcacggccagggggccggccagggcggcagcggccgagggttccagacgcaggccgtcggcggcgtgggcttcgccgaccagacgcagcatccgggcgtcggtgacggtgagcgcgccgtctaaaacatgttccagacaggcgcaggccagagccgaggggcgcgtcacagccaggccgtcggccacggtcggcccggtcaggcccaattcccgggcgtcgatgccggcatggcggccggtggccaatcccaggagcacggccggggccgtggttggttcgacggtaaagcacaaggcggcctcgccaagggccagacgtccgcccagggcgatgccgcccggcgcgccgcccacgccgcagggcagatacagacacagcggcgtttccggcgagacgctcaggccggcagcagccaatttggctggcagccgcaggccggccacaccgtaaccggtgaagagatcaacggaattttcgtcgtcgatgaaatgcagacggtcgttgccggccgcttcggcccgggccacggcgcaggcggcggcgtagtcgccggcgtgttcgaccactacggccccggcggcgcgcaggcggtcttttttccaggccttggcttcggccgacatgtggaccacgacggcaaaccccagcccccggccgaaaacgccgatggacaggcccaggttgccggtggaaccgacggagagggtctggccggcgaagaaggccttggcggcaggctcggccagccggcggcagtcgtcgccagggccggcgagcaggccctcggccagggccaggcgctcggccacgcacagcaccgcatggaggccgccgcgcgccttgaccgagccgaccacgggcagggcatggtcggcggccagatagacccggtcggtttcgggcagcccggcctcatggagtcggcgggctaggcccggcacggacagaagcggcgattcgaccacgccctcggccggcccaagctcaggaaaaagacgcgccaaaagcggcgcgaaccggtcgaaacggtcccgcgccgcttcgatgccggccagggtaacgggcaaggtgtcccggacttcggccatgggccggcggccgggattgacgaaacacacgggttctgcggcgcgcaggccggcaacaagggcggcgtccatagcgacaagctagcccaaacctgtccgccaagccagcccgcaacaatggtggtttccatcaagggggtccgggggggattatcccccccgaccgccggaggcatctccctctcttctaactattggccgcgtatttggcggcggcgcgggcggcgggggtggtgtttttgacggggggcaaggtggctggcggcggcgacggctgcagcggcggcgcggccgggagaacctgaggcgtcgattttttggcgttgccggccaggcggaagggcgaggcgaagcggtggccgcactccgggcaggccatgagcacaccgccgacatcgggcggaaaccgcagcgcctggccgcagccggggcaggtacgaacaagggcgtcggacatcggtgactccttggccggaaattatgcaagacaagtgcccggtgcgggcgggatggttacagccgggagggacattgcgcaggcgtcatggaaccgtggcggccgggtattcggccgggctgacagccgaccgcgccttattgctcccagaccggcggccaggcgcgcaaaaaagccaagacgaggtcgcggccttcctcgatggacagccgttcggcgtccaccacgcattcggcggccgggtcttcctcgaagggcacgtccacgccgatgacttgtcccaagcccgggaagtcacggccggtggctttgcgcatcatggccttggcatagaggccggccatgaccttgccttcgggacgggccgcctcccgggccatggccgtggccagggaacagcggacgtggatttcggcgaagtgcggcataagcgaccgggcgtagtcgcgcatggcccggcgcggggccgaggcgtccaggaccacgaggccggtcttttgccggtacaggccggccgcttcctcggcaaaaagcttgtaggctttttcgcgctcgccctcgctgtagctgggcttggggaaataggccttgcgccggtcgtcgagttcgagcagggccacatcgcccccggccagggtcagatagtggcacacggcccgggccagggcgcttttgcccgagccgggcagtccggtgaaccagatggcggcaggcatggggatcagtccatatagcggttgaagttggcccagtcgaagcggtcgtcttccaacacgttttcgagaaaccgcaacagcccctggcgcacggcttcgggatggccgggataccactggggcgaggccaccaccagcccccggaaaacgtagaacggcgcgatgacggcgagcatctccgcatcgtttgtgcgttccagataggtctcccagaaggtccggtagaggcgctcgaagtcgccgcccaggcgagcgccgccgtagaggccaaaaagcacgaaattgaggctcatggtggctacgtcgtcggccggctcgccccattggccccggctgcggtccagcacggcgaaatcacgcgtctcgcccccctcctgaatgagcacgttccaggggtggaagtcgccgtggacgtcgcttaagcggtgggtgaagtcccgaagcttccagcgccagtcaatgacgcgtttttccagggcgcaaaaacgctcgggcgggaacaactcgtagggatagggataggcgtccacgaggccgaagatgcattccgatgcgccgatcaaattgcggacgcggcgcagatagaggtcggcgtcgtccttcttggcgctgtgcacccgggccagccagcgggcgaactcccgggccatggccagatccttggcctccaggccggtcttttggatgcgggccaaatccagataataatcgtagcccggggccttctcggtgacgatgaaaaattcccggggccgggacacgggcacgaggttgtcgtcctcgtcgaaatagcccagggccatggggcgcacatgcttttccatctccccggaggtggcgtgctggaacatgaggatggcggcccggtcccagtagaactggtggccgtacttgtcgccgcgcatgatggacagcacgccccggcgcggctcgccgccggcttcaaattccaggcacaccggcttgccgtagccaaattccttcatgccctggtcgtccacgcccatctcgcaggctccggccaggcgcgcgtcaggcccgaaagcctgggcgaggaaacgctccaacgcctccggccgtatggtgatggctggttttttttcggttcctttacgcatggggaagaggcctccggcggctgggggcctgaggcccccagaccccccacttgggagaaggggggaaaggggttgtggacgtgattggcggcacgtcgcttataaagaataggcgcaggcggcggaggctgcaagggataaacctgtcgagggggccgggggatcatccccccggcggggcgcggggcggagccccgctcttatctcttcgtgaatccccacttcacgaaggcccagccgaggccggcgcatagggcggcttcggtggccacggtggccagggccgagcctttggcggctagcaggggaatcaacaggaaattgagcccgatgttgaccccggcggcgatgatggtgacgacggcgtagtagcgctcgcggcccagggccacgagcccctgggtcaggacgtagttgggcaggataaaggggagcgaggccaaaagccaggccaggagcggttcggcggcggcgtatttgtcgccaaaggccaggcgcaggatggagggaccaaggataaggccgccaagagtcgcgcacacggccagggcgatcatgacgccgagcatgaggcgaaaggagcggccaaaggccccctgatcgtcgaggttcacgcgcagtttgcggaaaaacacgtgggccaggggcgtggccagcatgatgacgccctcgatgaggcggtaggcggcggcgtagttgcccacggtcgcgtcgtcgccggtaaggaacttcagcagcacgatgtcgcagcggaagtagatggtggtggcggccgagatgcacaaaaacgcggcgcagggggcgtagacgtcgcggtagaggcccagcttcgggcgcgtgcgcagcggccgggcgtagggcgtggccagagccaacagctggcccacggccaaaccggcgaagacggccagggggccgggcgacgggaaaaggagagccgctccggcggccagggccgtggccgtgcgtaccacggcccgccataaggcttcggccgcgaagttgttgtggcccttgagttcggatgagacgagggaagaagcgcaaaaaagggcgtagtagatcacggccgcgcccagggacaggcgctcgcccaggggaaaaagcggcaccatgcagaacccgagcagcgtcacggccagcagatggcccagggccagggacaacagcggcggccggtccggaagatgggccagcccggccttggctgtttcgcgaaagaccagggtggaaaagccgccgtcctgcaggatggcgaaaagtgaccccagggtaaggaggtaggaatattcgccaaacacggccggcccaagcgcccggccaagcaggaaggtcaggcccacggacacggcggcggcgtagagggtggccgcccactggctactaagcgccttggccagggcgcggctcacgcgtttttctcctggcgggactgacaggcgccgagcggcattagtaactgtcctggagatccggccggtagggcaggatttcgggcgtgaggaaaagggaaagcggctgtccgccgttttggagcagttcgacggtaaaggggccggccggggccggcagaccggtgtaggacgaggtgtccaggaccgcttcaatgcgcatgggcgtgtcgtcgcgcgaccacagctggacgcccgggccggagaaatcgaagcgcacaaaaccattgtggaggggtttggcgaagcgcagcacggacacccggcgcaccatgagcccttcccagtggccggaacggttgttggccagggcgtcgagggttgtaaatttcgtgccgtcctcggaaaacgacacggtcaggcggtttttgccggccttgtcggcgaagatgcgcggataggacaggatgcgcagttccttgacgggataggccgagctcagcggcacggtcagcgaacagggcgcggcgtcgcggcaggccaggcagtcctcgtcgtcgtttttgcggatgttgtaggccaggggaaaggcggccagggcttcggcttcccgggcaaagctcggctcgaagcgcagcacgccgacgcccgagcgcgtcaagaggagcgtcgatggcgacggagccaggacgccgatgtccaggccgcgcccggccacggcgagctttggccggttgagcgcgcccgtgagcttgagggaggcgaattccgtgggcgtggcgtcgttttccaggagccgggccggtcgatccgcggccaggggcgtgaagggctgggccagggccgggtcgtagaggacgtaagcaggcttgccgtccgggccggggatggcgaaaaccggttcgaggcctgggtgtttggccagaaatccgggcagatcttcggccggattggccggtccctgggggatgtcgggccgggtcgggaaggcgtaaagcgcagcgtccagacgggtctggccgggcgtccaggcggccagggcgttgttggcggccacgcgctccaaggcgctttgggccggatcgacgtttgtcgggcggccggtgagggtggcggtcagttccaggccgttgacctcaatgacgccgggattggccaccgggccgtagtcgatgcgaagacgcagggttgtcgcgccggcaatggcctggggcaggggatagtcgcgatggatgaaacggcgcttttcgtagttgggggcaacgagcttgccgtcaggcccgaggaaagcctcgccggtcagggtctccagggcgaccaaggggccgtcgccgacggccatggcgatggtcacccgggaatcggacgggatgccctcaaggaagctggccgagaagtcgagggacagccggccggcggcgtaggccgtgtccggagcggccacgaagcggtagaggacatggccagggcgctcgtaatcgtagtgggtgagcgtgtggtagcggctttccggggcgatgttgtcggcttcctcacagtcggcgtagaagcggtagtcgtcgaatttgtcggcatagacggcgtttccgaccgcgtccgggaaaaggaccaccggggcggcgctcacaagccccaggcggtagacggcggaatccatgaaccgggcgaccttgtgcatgggaaagggcttcgtggccggggtcagatcgctttggatgacgtggtaggcccgcttgtagcccttgggctgatactgggccagggtcttgtagacgcctggcaggtaccagttggtgatgagcttgggattgcggttgctttgcaggaagaggtactcgacgttgttcttgttccaggccagatagtcggccagttccttgttgtatgacgtctcgcggcggtaataggacggcagggtggagagatccacagcggtcagcagcaggcagcagcccagaccggccaggggcaaggcgaaagcgcgccgcgacggcgaaaggccgacgtaatcggcgatgctgttcaggccggcgtccaggccaagcgcggccagggcgagcagggcgaaaaaggcgttgaacacgtagcgcgagctgatttcgagctgggtgccggcaagcagaaaggcggccacgggcatgagcgaaaaaagcgccagcaacaccaaccccggccgcaggcggggtttggcgacggcgacgcccagcccgccaaggctggcgagcgccagaggcagccagggcaagccccgcttgggcgcggcataggcgaaaaattcggtcagcacgctgatgacaaacccctccgggatgcccggggatttttcctggcgcagcaaggcgaaaatgttgcggtaggccggcagccagggcagaaagcacagcccgaccacgcccacgcaggcggccagggccagccctttgcggatggcctggcgcggggtcagttcgcgggaaaagaggccgcgcaggagaaaataggcggtgaaaagcccctgcgccccgatgttggtggtgcccatggaggaactgtagcacatggccgtggtggcggcggcgtaagcgacgtaattggcgatgcctcccctggcaagtgcgcgatagagcgtccacagcgacagaagtcccaggagggcgaacaggctgtaggggcgcagctcccgggaatagtggatgtggtagacgcaaaaggtcgtcagcgcggcggcgaaaaggccagcccgtcgggtgaagagttcgccgacaaagccgtacatcacggccacggtggctgtgccggccacgacgctgatgccgcgcaaggccgcgtcgtcgtgggtgacgttcagcacggcccgggtgatcaggtggtagagcggcggaaagaactcgccgccgaaatccgacggcccgatgacggaaagagtatggagcatccgcctgaccggcagcagggccgtgccgagggtgatgaactcgtcccaccacagggaaggatcgcccagatggggcaggcgcaggcaaagggctgcgaccagcagggcggccagagggagccaatacaggcggcggttgtcggtagtcggcatggagaatggttcccggaccccgggatgcggggtcaaggccatttagctaaggttttccgggatgacaaggccgggggcggcgatgatctcgccgccggccagcacccggccgtcggcgtcgtaaaggacggccacctgtcccggggtcgggcgggcgacggggtcggcgaaagtgatgtcgagaccgccctcggccgtcagccgggctgtggccggccggggcttcatgcggtagcaggtctgggccaggacggcttcgggccagtgctccggctgtacgaggcagttggccggtccagtgcggcaaagggtcgcggccagctcggccttgacgccgacaataagggcgtttgcggccgggtccttgtcgatgacgtaaagcggttcgctgtaggcgatgcccaggcccttgcgttggccgatggtgtgccgccatagcccctggtgcgtgcccaggcgcgtgctgtcggccaggacgatggggccggggcctgacagggggaagccctcgccctgcagaaacgcccggtagtcgtcaccgggcacgaagcagatttcgcgcgattcgctgggcaacggcggggtcagcaacagctcggccagggcggccgggtgctcggccttgcgcctgccagccaggggaaagacggcccgggccagggatttccccggcacgaggcttaaaaaatagctctggtcgcggctgtcgtccgcgccgcgaaaaagggccggcccggtcggcgtctgttggacgcgggcgaagtggccggtggcgatggcctcggccccgcgcgccagggcggcgtcaaggagcaggccgaacttcatgtcgcgattgcaggcggcgcaggggttgggtgtgcgcccggcggcgtaggcggcggcaaagggggcgatgacccgggcgcgaaactcctgcgacagatcgacggcggcaaagggcacgccaagggcgcggcactgggcgtcgatggcctcggccagggccaaggccttgtcgcccggcggcaggaaatgggcgtgcagggcggtgacgtcgtggccggcggcgcgcaggagacccagggccagcaggctgtccgacccgccggaaacggcgacggctatgcgcatggtattcaggggagaagcctccggcggccaaagggctgccgccctttggaatcccatctttcatgccaacgtctaccgacactgtagcccctggccccccagttggggtttccaaaggggctcagcccctttggccgccggaggcactcttctccccttcttccttagactgccgccggctggggcagcggcggcagcgcgttgccgaggaccttggccgtgcgcaggatggtggcttcgtcgaaggcgcggccaaagagctgcatcccgatgggcatggccgaggtcgtgcccaggcccacgggcatggacaggccgggcagaccggcgaggttcagggaaatcgtgaagatgtcgcttaaatacatctgcagcggatcatcgctcatctggccgatggtgaaggcggcgaagggcgaggtggggccgcagatgacgtcgcatttttcgaaggcgttaaggaaatcctggcggatgaggcgtcggacctgggcggccttgcggtagtaggcgtcgtagtagccggccgagaggacgtaggcgccaatcacgatgcggcgctggacttcggggccgaagcccttggagcgcgagagttcgtagagttcctccagggactgggcctcgggggcgcggtagccgtagcgcacgccgtcgaagcgggccaggttggaggatgcttcggccatggccacgatgtagtaggtggccacggcgtagggggtgtggggcagcgacacgggcacgacgttggcccccagggatttggccgtgtccacggcggcccggcaggcgtcgcgcacttcggcgtccacgccttcgccccagtattcgtcgggaaggccgatggtcaggccggccaggtcggccgcgccggccagggcagcctcgaagtcgggcacgtcgcggggggcgcaggtggagtccttgggatcggggccggcgatgacaccgagcacggcggcggcgtcgtcggcggtgcgggtcagggggccgatctggtcgaggctggagccgtaggccaccagtccgtagcgggaaacgcggccgtaggtgggctttatgccgacggtaccgcaaaaggcggcgggctggcggatggagccgccggtgtcggtgcccagggcggcgaagcactggccggcggccacggcggcggcggacccgccactggaaccgccgggcaccttgcccaggtcccaggggttggccgtgaccttgtaggcggaattttccgtggacgagcccatggcgaattcatccatgttggccttgccaaggataacggctccggcggcgcgcattttctcgatgcaggaggcgtcgtagaagggcgtgaaattctcgaggatcttggagccgcaggtggtgggcgcgtccttgacgcagatggcgtccttgacaaggaccggcacgccccacaggcgttggtcgggattggggccggcggcgtccagggctttggcggcggcgagagccgcctcggcgtcgcagtggagcagcgcgtgtattttcggctcggtggcctcaatgcgggcgaggcaggcgctggcggcctcgacggcggaaagttccttgcgggcgagtttgtcgcgcagggcagtcagggacagggtggtgatgtcggacatgatgcttcctttattgggaatcaaaacgcgctgcgtagctattaattaagtcgatgattgcgcgaagatgatcgcatacttcgtctttgttgttgttaatcggtaatattgttgtacgttttcctgtgcgaaatagtcctctgctctctaggagattttcaatttgcgttattaactctggatagtcattcatgtactcagttgtaatgtgcaatgatggagcgtctggtttcgctatcgcatagactacggctttgttgccgatcgtctttcttatggaaaagtttgtaattccagtttgtgttgtgtgtttgttttctttggagatttttacgaggtctttaaagatagcgttttgggggaatgtttcgagctgcatgtctatggaggcgaattttttctttggcgttgtttttctttgctgggtattttctgtttgtccaattattcttgagacatatgtcttgagcttgttgcttttgtttgtatattgttttatttcgactgcaagtacttcaatggtggccatttgggtgttcaagaattcaactagccggcgaagttcttttgtaatgcggtccgctacgaatagaagacgtattttgcaattcgcaatgttggtgtcgactgtagtccagaagtcatttataagttcaataccgtatgttccgtcctctggttttggtcgatgttctaaaaaattttttaaataaatttctgaattgtttgcgtgtgcttgcttgaaaaggttttttagtgtgccatttggccaatattccgttgcgtttgctgcgtattccaatagctgagcgacaacttcacgtcgtaaacgtggatcagatgagcgcttgcattcgattaaagttggtattccctcgtggtcaataaagatatgatctatcctccagtaatttgagccattttcttctgaaggtatgcctgcttcattacatacaagcaaccatcggcgaggatcttcgggattgatttgatcacccggtattaggtctggatttcttgctaagatagtttgcaaaacaatctcagcagagtattcagtctcatcaacagggatgagatcactcgcgtcgttgcttgcgataaaaatttttgattttggaaacacgactatcccttgtccgaggtaaaagcagaggctacagcggtcgccccgcgcctacacgatcttggggacgatgaagaactggccgtcggtggccggggcgttggccaggatctggtcgcgggaacaggccttggccgccacgtcggcccgcatgggcgtttcgtgggtcaccgggctgtacagcggctccacgccggccgtgtccaccgaccccagcgtttccatgtaggccaggatgccgtccatctggccggcgaaacgttcgagtttgtcgtcgtccaggcgcagccgcgccagcttggccaccttggccgcgtcttcggaagagatgggcatgacgtcgttatccttggggttgggaaatcgaaatcgcctggcgatgggccggaaccggcgcggccggcgtggccggcgcgggctgggccgggacgggctggctcggctgggccggaacgccgggctgaccgggcgcggccggggctggctggaccggcgaataggactgctcgttttccggggccggattctccagagccttttgccggatggcgtttaagcgctggcggaagccttcgggatcgagcagcaccgggccggtgaccgagggtctaaagagatacatggctacatgggccttgccgtcggggccgtaggacagcggggccatgctgaagtccaggccggtgacggcctgggcaagccgggcgctgacgtcctggggcggcaagccctggggcaggcggcccaggcgcgcggccatgcgggcgaagtcgaagcccacggcctcccacatgtcgggatgctccacgccctgggcgcgcatggcggccacgagctgctgggtggcctggccctggttttccggccaccaggctccggggcacacggccagacggtagttttggatattgatctgggccttggtggcggcggcccgatacagggcttcggtccacaactgcggcccgaggatcagcaggtcctcgacgcggttcttgaaaaaggacggcagcaccttgtcggccctggcccattcgtcgggcaaaaacaccgcgccaaagcccggacggctgccgctggtgtgcagcatgtcggccacggcggtttcccagctggccgggtcctgggggttgtagacgccagtggcggtgagctgcgcgccgatcttggaagcggccagggcaaaggcgtcgcccatggtctggccgtagcggtcgccgggacgcaacacggcaaactggttgatgccgtagtcgccgtttgccagtcgcagcagggcgtcgatctcgtcctcggcgctggggaaaaagcgccaggcgtccacgccttcccgggcttcattgagggagggcatgaaggccacgaaaacgcgggtcggcaacatgccggcagtttcgagttccttgagcgtcagccggtgcatggggccgccgaccacggtgacctcggggggcaggttgcgcacggcgtcgagccagcccggctgggtggcgtcgatgacgtggacatccaggggcgtgccggctttttccagctgctcctgggcggccttgacgcccttttgcacccgaccgccaaattcccgaaacgggccgccaaggggcagcagcatggcgatggaattggcgaaggccggcttgggcggcggcgtcggctcgggctggaccaccggaaccggtggcggcgtcggcgtcggcgcgggagccggctgggaggaaccgaaaaagctcccggcgcaaccggcgagcgatgcggcgaggaaacaggcgacaagcccggccaccaggcgcggggcgaagaagcgatgcgtggtcgtgacgttcattgggcgaaccggggtttggcggccgggccgccgtggcgtgagggcacaaaaaaagcccgacccgtccggggacgggtcaggcttttcgatacgcgcaatggctggcgaaggcaagcccgcgcggggccggtcgttatttcacttcggtgtagtcggcgtcgaccacgtcgtcgtcgccgccggccttggctcccggctgtccgccggccgcgccggcctggggaccgccgggctgtccgccctcttcggccttttgctggtagagcttttccgccagcttgtgcgaggcctgggacaggtcgtcggtggcgcgcttgatggcgtcggcgtcctcgcccttgagggtttccttgacgttgttgagcttggcctcgatctcgccccgggtcacgccgtcgatcttctcgccgagttccgccagggacttctcggtggtgtagaccagggtgtcggcctggttgcggatctcaatgagcgcctgcttcttcttgtcgtcctcggcgtgggactcggcgtccttgatgagcttttggatgtcggcttccgacaggcccgaggaggccgtgatgcggatggactgttccttgccggtgccggtgtccttggccgagacattgacgatgccgttggcgtcgatgtcgaaggtgacctcgatctgggggatgccgcgagccgccggcggcaggccggtgagctcgaagcgtccgagggtcatgttgtcatttgccatgggccgctcgccctggagcacgtggatggacaccgagggctggttgtcggccgccgtggtgaacacctggctcttgcgggtcgggatggtggtgttgcgctcgatgagcttggtaaaaacgccgcccagggtctcgatgccaagcgacagcggggtgacgtcgaggagcagcacgtctttcacgtcgccggccaggatgccgccctggatggccgcgcccatggccacgacctcgtcggggttgaccgagcggttgggctccttgccgaagaactcctgcacggtcttggagaccaggggcatgcgggtcatgccgccgaccagcacgacttcatcgatgtccgaggccttgaggccggcgtcggccagggccttgcggcagggctcgacggtgcgcttgaccaggtcatcgaccagggattcgagcttgccccgggtgattttcaccatcatgtgcttgggaccggaggcgtcggccgtgatgaatggcaggttgacctcggtctccatggccgtggacagttctttcttggctttttcgccggcttccttgagacgctgcagggccatgcggtcctgggacaggtcgatgccgttctctttcttgaactcgtcgaccagatagctgatgacgcgatggtcgaagtcctcgccacccaggaaggtgtcgccgttggtggcgcgcacttcgacgacgttgtcgccgacttcgaggatggagatgtcaaacgtgccgccgccaaggtcgaagaccgcgatcttctcgttggcctttttgtcgaaaccgtaggccagggacgcggccgtgggctcgttgatgatgcgcttgacctcaaggccggcgatgcggccggcgtctttggtggcctggcgctgggcgtcgttgaagtaggccggcacggtgatgacggcttcggtgacgggctcgccgagataggcctcggcgtcctttttgagcttgccgaggatgatggccgagatctcggccgggctgtacttcttgccctcgacctcgacataggcgtcgccgccctggccctcgacgatcttgtaggggcagtgctccagccaatgcttgacctcgggggcgtcgtaacggcgacccatgaggcgcttgatggcgaagatggtgcgctcgggattggtcacggcctggcgtttggcgatctcgccgaccagccgctccttggtaaaggccacgatggacggggtggtgcgtccgccttcggggttggtgacgcacttcgggtccttgccctccatgacataaacgcaggagttggtggtcccgaggtcgatcccgatgattttacccatatcagcctttcctccttatcattgcctgtatgtgcttgtgccttgcggcgcggtatttctcgaacgagagctatataagccccgttttcggcgagtaaaggggcagccgcgaaaaaacgatttattgcgccttgttgaccatgaccttggccgggcgcagcagtcggccgcgcagcagatagccgcgctggaccacctgggccacggcgtcttcggccagaccggccacgctggccacgccgatggcctcgtgggtctcgggatcgaaggcttcgccgaccgcgccgaattccgtgacgccgtggcgggccaggatgtcgatgaaggccttgcgggtcatgtccacgccgacgacaaagtccttgcaggcttcgttgccgcgtccgtgggccagggccaggtcgagatggtcaagcaccggaatcagttccgagaccaggctttcggtggcgtatttctggaaatcttccttttccttgatgagccgcttcttgagattttccgtttcggccagggcgcgcaggcgcttgtcggcttcggcggcaatttcggcgcgcaggcgttcgatggtgtcctccggggtggccggggtttcctcggccggggtttcgggggcggtttcggcgtctggcagtttttcctcagggaccatgattcctccacaacaaacgtttgggcgcgacgaaaagcccaggcaggcccgggcggtcgcggacgagtcgaggctaatagtgccgatcgagcaaccgggtgagcgccccggcggtgtagttcaccaccggaacgagccgggcgtaatccatgcgcagggggccgatgaggccgatggcgccctgggcgcgcgatcccgacccatacggggcggtgatgacgccaagatcggccagggcggcctggtccgactcatcgccgagtatgatgaccgttttaagctcgtttacggttttgtccagaaggtcgagcagaatcgtgcgctcttccaggacgcgcataagctcgcgcatgtgttcggcgtcggtgaattcgggctgggccagcatgttgggcgtgccgtcgacgatgacttcgctggctggggcgcgctcctgctcaaaggccgagcgggccatggtcagggcgcgcagacacagggcgttgagcgaacgccgggcctcgtccatctcgcgcacgatgctggcccggacttcggccagggttcggtcggtgaaaagatggttcaggtaattggcgcacacgaccagatcgtcgccggtgacgtccggggtggtctcgatgacgcgcttgcgcacaagaccgccctggagcaccaggatgaccatgaccaggccggggttgagcagggaaaagtcgatgcgcttgaagcgcgcgccggccggattgggggcgatgaccaccgacacctggagcgacaggccagacagcagccgcgaggtctggcgcagcacgtcgtcgatctccaggccggccaaggtgaggttgtcgcggatgcggcgcatctggtcttcgcccaggggggccacctgcatgacctggtcgagatagagccgaaaggccttggccgtgggcacgcggccggccgaggtgtggggctgctccaggtagccggcctcggtgaggtcggccatgatgttgcggatggaggcggcggaaaggcccagcgaactgcgcttggacacgatgcgggaacccacgggcgcggccgaagcgacataggcttcgatgatggtggtcagaacttcccgttcgcgttcggcaagaggcatggcgtgtccccgtttggcactcgtggctttcgagtgccaaacgggtaacaaccgaatggtccggtgtcaagggagaggccggaaaatgcccggcatcatgcaggaatcacgagtattttgcgtttggaaaggggcgggcgaaagcgcttcccccaaagggggccggcgcgccgcggcttgcgcgccggccgccgccccgtgggcggggcggcattggagccgagagatatggtcagacagcggcagtcccgcttcctggccccgttacggctgggtgtggtcccagaccggccgtgggcgcctcgaagggatcggcgtgggccggccggctcagtcctggccggggagtaagcccgaagggccggggcccaggtcggtcggggccgggcgcagatcggcttccagggcggcccacagggccacatgggcctgccgagcggcttcgtccgaaggccgggaatcgtgcatgagggccgaggactgcaccatgccgcgcagttcgcggaagccttggcgagcggccaccacggccgaggcggccggcgacacctggggcagaagttggcccaggccggacagggacatcttggattcacgggcctcgtggcggctgggcgaggcgtcggccagcacggcgcagtagccgatgcaggccgacagggtcacggcgacgacggaacgggaaaggcgcatggatgctccaatttggccggcgttgcgactgccggcgctactaagtcatatcatctgatgtttatgttgtcacgctctcggccaaggagggccgtcccgggacggcgaagcgacagctccatcatatcatctgctgttttgcggcgggctactccagacaggcgactgccgccgcgcacaagctgatctgctgtcttatcatctgatgtttgtcaacagcaaaaaaaagagcctcctggctattctcccaaggccttgatgtcgctggtgaagtggtcgaggccttccatggcgaaccgggccgcttccgggccgtcctggcgggtgatggcgtcgaggaggccgttgtggatgtggtcctggtagcggttgacgccgacatcagcgatgagatggtcgagaaaatcctgaaataccatgcagaagctgcggtacaggtcggccagcaggctgttgccgctggcggcggccacggcggagtggaaagcgacgtcggcggccacgtagccatgggtgtcgccggcggccacggcggctttcttgcgggccaggcaatcgcgcatggtttccagatcggcctcggtgcggttgccggcggccaggcgggcggtttccacctcgatgatgcggcgcacctcgcggatctccacggccgtggcccggcgcaggcggtattccaggggttcctggccggacgcgccgctgaggacataggtgccgtcgccctggcgcacttccagcaggccggcgctgaccagcacgcggatggcttcgcgcacggtggagcgtccgaccccgagttgggccatgagcgtcggttcggtggggatcttggtgcccggcgcgaaaatgcccagcgagatcttttcctggatctgctggatgacgaggtcgcacagtttgcgcgaacggaccgggctcaggcgggcgggcatcgtctgatgatctcctcaaagtcttgagcgtctctagtgccggcctggggccatgtcaagggggcttcccgggtttgcgcgcaaagaccaccctttggcaagccaaaatcgggccttccgatggatttttcggcctgccatcggaagcatgtattggatttggcgcggtggcgcgggtaggaagcagggttcacgacaacagcagtgtattttgccgggagggatgcatggaaaaggaaactggcgcgtcgcgccggcggtttttgcaattggccgcggcctcggccgggacggcgctcctgggagcgcggccggcggccgcttcgggcccgggcgaggtgttgcaggtctggtcctgcggcgggctggccgaggccatgatgccggccaacgccgccttcgaggcggcgcgcggggccacggtcgtctataccggagcctttgccgccgccctgggcaagtcgcttctgggatcggccaccaccgacgtcttcgccggccgggttctcgatctggccaagaaattgcgggccgagggcaagatggcctggttcaagcccttgtgcttcacccaatacgtgctggtcacgcccaagggcaatccggccggcatcgccagcgtggccgacctggcccggtccggcgtcaaggtggtactggccccggaggcctcgccgcctggcggcgcggcggcgtttaaaatcctggaaaaggccggcgttctggaagcggccaagaaaaacgccgttgtcatgggcagttgcgtccagcgcaccatggacgacgtcattgccggccggggcgatgtctcggtggtggaactgcggcttacccgcctgccggccttcgccgggcgggtggacatcgtgcccatcgacgagaagctcttccccccgccgcccatgactttcaccgtgggcgtcatgcaaagcgccaaaaaccgggaactggccgaggcctatgccggctatctcgtttcgcccgagggccaagcccatttcgagcgcatgggcttcgtgccggccgtgtcggacaagggccgcgaactggtggaaaaatacggagtgcgggatgtctgagagcctggcggccaaggccgccccgaaaacgcggctgaaggtctggcgtagggcgacccaggtccttggcgcggccgtccttgggcagtggagtctctatggcatcctgcgttgtcccttcgtcgtaccctacgtgagctgccagaactgcccggtcatcacctgccacggccggctgttgcccatgtactggggcttttggctcgccctgccggccagcctgctcctttttggccgggccttttgcggctgggcttgcccgggggggctggccgtgtccctggccggccagctcgcccccttcggccgggccgtcgttggccgcatgtcccggttgttccggtggaccgcgacgggcaagtacctggccctggccggctgcctctacgtctactacgccctgggccagccccgggtggacgtgcccatccgggtgggagcctttttccaggccgccgccctgaccttcgagcacgccatgccgttgtggctgtggcgcaccggcgcggtgctggggtttttcgtcctgggcctggccctggccggagcctggtgccgcttcgcctgccccaccggcggggcgctggagctcctcaagggcgcgtcgctgttcaaggtctacaaaacctcggcctgcaacggctgcggcaaatgcgccacggtctgcgaaatggcgacccggcccgaggaaaccaactgcaccaactgcggcgattgcctggacagctgccccgtcgacgccatcggcctcggccgcaagccccgcgaagcggggcgcagctaggggtgatggaaaggggtaaggatgagaagatgcctccggcggccggggggcctgagacccccggaccccccaaataggaaaggtttaagggggggcgcgccgggtcggcgggggagaagctagccgagcggcgaaacggtcagggtcaggccgccaagcgtcaccgtggaggtgaagaacgtggtcgtctcggtggaagggatgccggctttggccgcgtcatagtcggcggcggcggtcaggtacaggcccgtgccgtggacgcttaagtaggaagccggatcggccagcagtgtggacaggtcaaggcccgagtcgaggctgcctgcggcgtcgctgaagctcacggtcaggccggcggtttgtgtgccgagctgcgtggaatagtccgacggcgcgacgaaattgacgatgcgcgcatcggcggcatagccggcgtcatcgccggacaggcccatggagccgaagaccacggcggcgtagcgcgtgtcggcgtcgtcgggatgcgcggccatgtaggcctgggcggccgcgccgccgaggctgtggccggtcacgtagacctggccgatgccgaggctgtccacggcggcgtcaaaagcggccgtcttggccgaaagctggtcgtagtagcccacggtgtcgaaccagtaggcggcgtcggcgctgccgagataagccgtcaggccgtcggtggaataatcgatgtcgtcggtgccgcgaaaggcgatgacggccacggtctgattgttggctaccgtggtccaggcgtcgaaggcggcgctgccggcctttgacgtgccgttgccgtcgccgtcaaggtcgagctggacgtagccggccccttccagggcgcttatcagggaggcgtcttctcggtagctggcctcggtgataacagccagggaggcgtcaagattggcggcggtcagggtcatggcggtccgtttccggcggcttggggcaacaggccgttttcgccgggcaattttggcccaggctacgctcgggcgggcagggcgtcaacagggcggctcgccgccctaggccaccttgaccatggaacgccgcatgtcctcggccgagtgcatgtcgatgacccggccttcgccgtagcgcaccacctcgccgccgaaaaaggccacatcggccggatcgtgggtgaccatgatcagcggaatgtccaggcgcgaaaggatgccggccagctcggcccgcaccttctggcgcaggggaatgtccagggccgagaagggttcgtccaggagcagggcgcctggctcgcagaccagcgccctggccagggccacgcgctggcgctggccgccggaaatccgggccggacgcaggtcggccagcccctcgatgccgaaaagggccagggttttctggacgtgctcggcggcctggggcgtgagccggccggtcaggggtgagaggccaaaggcgacgttttgccgcacggtgaggtggggaaaaagggcgtagtcctggaacacgtagccgatgcggcgaagcctgggcggcacgaagacgtcctgggcggaatcgaaaaagacccggccgtccacgctgatggagccggaatcgggccgcagcaggccggccagggcgcgcagcgtcagggtcttgcccgaacccgaggctccgaacagcacggcccggttgccggacacggcaaaagcggcgtcgagatgaaattcgcgtccaccgcagcagtaggttttctggatgtccacgacaatgcgcatgggcggctccgatgggcggctggttggacgctcccggggccggccccgggagcgtcatggaaacggcgggccttagggcttcttgaagccgtacttggccaggatggcctgtcccttggagccggtgacgaaagccacgaaggcggcggcgtcttttttgtccttggcagcttccaacacggcgatggggtaggtgaccggggtttccacgggcacttcaaggatggtcttgaccttgtcgccgccctgcttggcgtcggtggcgtagacgaaaccggcatcgacctcgccccgggacaggtagtcgagcacctggcgcacggactcggccagaacaaacttgccggagatggcgtcccacaggccggtcttggtcagcgccgccttggtgtaacgtccgaccggcacggaatcggggttgccgacggcgatgcgcttgacggccggcgcggtgagattggtcaggtccttgagcttggccgggttatcggccggcacggccatgaccagggcgttctggacgaagttgacccgcgtcggcacgtcaacgagctttttctcgacggcctggtccatggtcttctggtcggccgaggcaaagacgtccacgggcgcgccctgggccatctgggagagcagcgcgccggaggcggcgaaattaaacgtcacgttgacgccgggatggtccttggtgaacacgcccttgatttcattgaaggcgtcggtgaggctggcggcggcggagacggtgatgtcgccggcggcggccggagcggccagagaaaggcacagggccagggtaagcagcagttttttcatgcgtgttccatcctctaggctttcggtttcacgattctggcgacgaacacgagaagcgccacgcaggccacggaaatgagcagcaccagttcgttggccagggcgtcgttgccggcctgagtggcgctgtacacggccagggacagggtttgggtcttgcccggcaggttgccggccaccatgagggtggccccgaactcgcccatggcccgggccagggccagcaccacgccggccacgaccccgcgcagggccaggggaaacgacacccgtaaaaagatggccgtctccgaagccccaagcgtcctggccgcgttttccagattgccgtccacaccctcaaaggccgccctggacgaacggtagaccaggggaaaggccaccaccgctgccgccaccaccgcgccctgccaggtgaacatgatggtcaccccgaaggcgtcccacagccaggagccgatgatcccgcgccggccaagcaccacgatgatgtagtagccaaggaccgtgggcggcagcaccatgggcagtgtcagcacggcgtcgacgacgtcgcggccggggaaatcgcgcacctgggccaatcgggccaggcagaccgccggcagagcggccagggccgtggccagggtggccaccttgaaggtgaggagcagaggcggcaggacgctggcgtctagcatgaaaaggcgtctcccgtgtcagttgccgctgcgccgcgacaaaatgaaaggcatttatgtcgtggcggacgataatctgggcaacctacatgacttcattgcataaagtacagaatgtcacggcaaatagaatatgggtgtctctttgtgctgtcgacagacgtcgttgcggcacgcttgatggagaagtgtgagagtcacttgtttttatattgccgtgtcagttgtcttgctgacgtctggcgcgtcggcggtcacgttgatcgtcgtgttccacgggacagggaaccggtgcgggctgtttgcgaagaagtctttcaagcagggcttcgataaggggcacaagcatggcggcctcctggctgtttttctttgaagcaaacttgatgccatggcagaagccctggcaatgtctgaaagtataaggccttggatggcaaagggaagcggcgtcgccacaagcgacggttttgtccgacatttttgtctgtgcagtggggcaaagacggcttggcagggatggagtcggccgtcagggtaaggccgggatcgtggggtttggccgcgctgccgcgagggatggtcggcgaagacccggcgaggcagcacggagatggtaaagccgctcggctgcggggtgaggaaccggccagggtccggtgaggctgtacacggttgggaggtcaaaggaaagcgcgtagacgcagaagcgcgaggcgttgccggcgtagcagagccggaaaggggtgttgccgccaaagggcgggtcggcctcgtgacggcctggggagcggttcgggctcagctcagcacggacagggcctggtcgagataggaaccaatggcctgtttggccggttcgggcagcttgcgaaacttgagccccagttccaaccggcggccggacagggagacgcgcttgactactccggccagggccgtgtccggggattggccgaaaaggccgcagcgcaacagcacgtcgtcgtctatggctacggccggggccttggtcggcgtggtctcgggcaaggcggcggaaaacaggcagccggagtggctgaggtccaggaccatgcccgccagatcggccccggccacgcaggcctggcccggcagacagcaggccacccgtggatggcggcgcaggtcgtgggattcgagctttttgggaaaggtgaaaaagaccaggggaaagggaatttggataaaccggatgacctgggtggaaaagcccaccaccgtgccttcgtggagatagcgcacaatggccgtattgtcgggatacaggagttggtagagggcctcacggccggtgtccggtacggccggggcctgggtgacgacgaaacggccgcgcacgtggcccacgcagaccgtggccagcttgtccggtaacccggacagttccaggatgaccttggcccccggcgggcagtggaagtggttgaggtccgggacgctcatgacgggctaccgccttcggaaacagccccggcagcgccgtttttggccagaaaatcacggtacttgcgggcggcgtcaaacgcggggtccagggacagggcggtttccaggtggctgacggccctgtcgatatgcccggattcggccagggcgcgggcgatgttgaaatgcagattctcgtcagcgtcgttgtgttccagggccttgccgtaaaaggcgatggcctcggtgaagtgcttttccttgcgcaggctgatgccgaattcgttgaacagatggcgttcctgttcctggaagatggcgtcgttgctcataagccggcgcatggccgcggccagcttcttgccgtcgcccttgtgcatgtggatcttgccaagctcgatgttggccttgggatgcttctcgtccaggagcagggccttgcagaattccttttccgccgcgtccaggtcgtcatcggccaggtacttgtcggcctgggccagcttttttttgagcgaatcgacaaagggcaggcagcgcttctcgtaatatcctacttcaggagtgtagtttttgatgaattcgcccttggtgacgacagccagcggccccgaggggatggaattggcgttaagcgcctgcactacatattcgtcgtcctcggtacgacgcacgaaccacagggttttttgttcataggtgcgggtcgtggccccatggccggtgcccgccgccttgaccagggaatacacgcccaggatgcggcaatgggccagtgggttctcgtcgtgttcctcatcctgctcgggaacggccgtcatatcagtggacacgatgcaatccatggggtcggggcgattcgaccaacgaagacaagtgtgagtcgaagaaattgccgggttttccaggcgaatgcggaagattagcaatcatgcggcagcctggtcgggcgaaaaggcccaactacaacagtaaccgactacacccggtcaggcgtcttgtcaaaacaaaggcgacgccgtgtcgaaacaagcgccgcccctgtggagttcgatattgactaactgattgcctgttcgcgtcgtgtcccttccgcctgtcgtatggatgcaccggatccggttggtcccacaggttggccgggaaccgagggacggtcccagcccgccggcctagcagccctcgccaccgccgccgcaacaggccttgcccagacccttgcgtcggcttttgagcttggacaggtcacccgcgccgtagacctcggccagggccgattccaccagacccgagcattcgtagggcagcaccccggaatcggccagaaccttgcgcggtgtctcgccgcaggcggcgatgagcacggcccggcaatccagaagaagcttggccatgtcgatccagcgcttggtaccgccgcccggttcgggcgcgtagcggtcctcgacaaagacgaagttgtcgccgtcctgtttccaaatctggaacttgtgggcctcgcccaggtgcatgttgacgagaagcccctcgcggctggccacggcgacgtagggccgcttggccaggtccacgcccggcagcgccttggcgcagtcgccgaggatgccggccatctcgcccgagaggtccttgcccagaagccccacggcgtcggcccggcaacgcttgcaatgggtcatctggggcaccacgtccttggccttttcgcgcaggttgtggatgagctcgtgggtgggggcgggcacgtcggcaaagggcgtgtcggccaccgggaagatgggcatgatgttttggatgtccacgccaagctccgacagggtcttggagacctccagcacgtgatggtcgttgacgccagggatgacgatggtgttggatttgacgatgacgtcgtgttccttgaggatcttaataccttcgagctggcgggacagcagcagggcggccgcggcctcgccccgcaggatgaccttgccgtcgcgggcccaggaatagaccttggccccgattttcgggtccacggcgttgaccgtgacggtgacgtgggtgacgcccagttcggccagggtcttggcgtgggcaggcagggccaggccgttggtggacaggcagaagagcagatgcgggtacttgtccttgagaagcgcgatggtctcgatggtctcgggattggccagggggtcgcccgggccggcgatgccgaccacggtgatgcggggttccttttccagcaccttgtccatgtagagcagggcctgggccggggagagcacggcgctggtgacgcccgggcgcgattcgctgacgcaatcgtacttgcggttgcagaagttgcacatgatgttgcacttcggcgcgatgggcagatggacgcggccgcaggttccggcggattcgcgattgaagcacgggtgcttggagaggtccttttcggtggtcatgatcgcgctcctttagagatagccgtaacccacggcgctgtcttcctgcttgcgttccaagacgacgttgacgagtcggtcgaaaagttcctgggttccgccgtaggccacatggcgcatccgctggccgccgaagcggtcgtggatggggaaccccacccgcatgagcggcacgttccaggccttggcgtaggtgtagcccttgctgtggccgaccagcagatccggggccagatcggccgcctgctcggcgatgtcgtggaagtccacgccttcgcgcgcctcgggcggttcgggcaagagcccctcggtcacggcggcgagctgggccttgaagttcttgcaggtcgcgccggtggcgcacaggatgggcttgaccccgatctcggccaaaaaggccgtcatggcgatgaccaagtcttcctcgccgtagacgatggcgcgcttgccggccacgtacttgtggccgtccacataggcgtccaccagccggccgcgctcgtcctggtacttcttgggggtgggcacgtcggtcagctcttccagggcggcgaaaaaggcgtcagactcgcggatgccgaccgggatgccgacccggaggttcttgacgccaaagcggcgttccaggttggccccggccgattcggcaacatggtcggcccggccgcattcgatggaccccagggccccggacatggcccggatgtcggccagggtggtgccgccggccgggagcttttcgtagtcgagcagggccggccggtccatggagtcggagatgtccggcaggaccgtggcggccacgccgaagtcggccaggatgtcctttaagtgccgcaggtcggccggcgacaccaggccgggcatgaggttgacccgccgctgcggctcggccttgacctgcacgagctgggaagccagggcggccacggcggcgtgccagccttccatgtgggtgccggagtagctcggggtggagacatggacgatctcgggcaggggcagatcgctgaactccttgcgaaattccgccagcagccggggcacgtcgtcgccgatggtctcggtcaggcaggtggtggccacgccgaccaccgacgcgccgtacttgctcatgacattgaggatgccctttttaaggttgggcccgccgccgaagacggcctgcttttcgcccagggccgaggaggcgatgtccatgggctcgcggaaatggctgatgatgtagcggcgcatgtaggtggcgcagccctgggagccgtgcaggaaggggatggccccttcgacgccccgaaaggccagggcggcgcccagcggcgtgcacagcttgcaggcattggtggtggagacgtagggcgagtcgctcatatggcctccttcttggcggcttcggccttggccatggcttcgcggcgggggacgaaccgccagatggggctggtggccgaggcgtggacctcgcgggcgaagttgagcatcccgacaaagccttccagggcttccttgcgttcgtggttgtggtcgcaaaagccgaccccgagcttgtgggcgatgggccgctccttgacgccgccgacaaagagatcgacgtcgagttccttgacgaacttggagagttccaaggggttggagtcgtccacgatgaccgtgcccgggtcgcagatggcggccagctcctcgtagtcttccttggtgccggtctgggaaccgacgagcaccaccttcatgccgaggtgccggaaggccttgatgagcgagaaagccttgaacgcgccgccgacgtagatggccaccttcttgccttcgaggtccttgcggtactgtccgagctggggcagcagcaccgagagttcctcgcgcaccacctgctgggcgcgttccataatgcccgggtcgcggtccttgaaatgttcggccacggcgtagagggagtcggccatgtcctcgatgccgaggtaggacgcccggataaacgggatgccgtacttgtcctgcatcatcttggccagttccatggtggccccggagcactgcacgacgttgagggccgcgccgtgcgcccggcggatgtcgtccacccggccgtcgccggtgatgttggccacggtctccacacccatgcgcttgaagtagtcgcggatgatccagatctcgccggccaggttgaagtcgcccaggatgttgatggaaatggggctgatgtcggaggtgtcgccggagccggtcagggtgaacatggccttgcaggcggcggtgtagccctcgcgcttgttgcccttgaagccttcggactggaccgggatgaccgggatgccggttttttcggccacgtcgcggcacacggcggccacgtcgtcgccgatgatgcccacgatgcaggtggcgtagacaaaggccgccttgggcttatggcgttcgataagttcgagcagggcggccttgagctttttctcgccgccgaaaatgacgtccttttcctggagatcggtggaaaagctcaggcggtgcagttccgggcccgaggacagcgcgccccggatgtcccaggtgtagacggcgcagccgatggggccgtgcaccaggtgcagggcgtcggcgatggggtagagcaccacgcgcgagccgcaaaaaacgcaggcccgctgggacaccgccccggccaggctgtcgcggttgcaggccagctcgaagggcccctcgccggtacggtggatctgatcccgccgctcctcgaaaatcgcctgttccataacgctccttttcctgtcgccaattgtcaggacgatcgtgactctacaaggagcgtgccagattgcaatatattgattttattgatcgataacgctggaaactgtgcctggaaacaaatttgtcgcagactccccgacagaattgtagaccgagcgcgacctttgtcggaaaaatgcgcgtgcatgaccaaaacacgttttgctcggccggctcttcctcaaacggcctgtttcgcagctcaatcgactcattcgtcgggtttttcaggccgcaagaggctggaattggtcttctgtctgttttgacacaaccaggcaaggcgtctacacggcccgaaagcgtcggcgcgcagccggccatgccccaggaggaaatgacgatgcttcacgatatgcgccttttccgggaagcctgcctcatcaacggccagtggacggcggccgataacggcgagaccgtggccgtggacaacccggccaccggcgaaatcttcggccatgtgccgcgctgcggccgcgaggaaacccgccgggccatcgaggccgcccacgcagcctggccggccctgcgggccatgaccgccctggagcgggccgacatgctcctgcgctggcatgacctcatcttggccaacaaggacgatctggctaagctcatgaccctggagcagggcaagtccctggccgagtcggccggcgagatcggctacggcgcgagctatatccgctggttcgccgaagaggcccgccgggcctacggcgacatcgtccccgccaatgcccggggccgcatgatcctcgtcacccgcgaaccggttggcgtgtgcggcgtcgtcacgccctggaatttccccatggccatgatcgggcgcaaggtcggcccggccctggccatgggttgccccacggtcgtcaagcctgcctcccagacgccgttctccgccctggccctgggcgaactggccatccgggccggcatcccggccggcgtggtcaacatcgtcaccggcaacgcccgggccatcggcgcggaactcaccgaaaaccccaccgtgcgcaaggtcagcttcaccggctccaccgaggtcggcaaggcgctcatggcccaatgcgccgggaccgtcaaaaaggtctccatggaacttggcggcaacgcgccctttatcgtcttcgacgacgccgacatcgacgccgccgtggccggagccatggccagcaaataccgcaactccggccagacctgcatctgcgccaaccgcttcctcgtccaggccggcatccacgacgcctttgttaagcggctggtggaagccgtggccggcctgtccgtgggcaacggcctggaccagggcgtgaaccaaggcccgctcattgacggcaaggccgtggcccgcatgcacgcccaggtggccgacgccgtgggcaagggcggccggctggccctcggtggcaaggcccatgccctgggcggcaatttcttcgaacccacggtcatcgcccacgccaccccggccatggcctttgccagggaagagatcttcggccccctggctccggtattccccttcgagaccgaagccgaagccatcgccatggccaacgataccgaatacggcctggccgcctacctctatacccgcgacatcggccgggccatgcgcgtgtccggggcgctggaatacggcatggtcggcgtcaacgagagcctcatctcttgcaccgaagcgccgttcggcggcgtcaaggaaagcggcgtgggccgcgaaggctcgcgctacggcatggatgagtactcggtgatgaagtatacctgcctgggcggcttggcgtaggcggggaggcaatgcctcggcccccaaaccgtgagggtccgggagggggtaccccctcccggccgccggaggcgtcactttatccccggttctactttccgcgttcccggcaccacgccgcaacagcccgggctatggctcgggctgtttgcgtttggcgggcctgggtgagaagcgcttgttcctcggccgggttgacgatgacgccggcttccaccagcacggccggtatggtcgcggcgtggagcacggccagtccgtcgtagcggtagacgccggcaatggggtccacgatggggcggccttcgcccgggatgtcggcggcgtggtgggagctgaagggcaggcctgaggcggcaagctcccggcccacggcccgggccagggccaggctggcggcggcctctttgttgcgctgggaatagaacacaccgtagccggcgaagcggtcgcagacgcgacgcggcctgccgtcgatgacggccgtggtgaaaaactggggttgggcggaatcgtggtggatggagatgagcaggccggctttggcggcgttggctcgtgcggcccggccggccggaggcaggtccgtgccgacgggatcaatgagaagggccttgctgaagccggcctggaccagggcgtccttgaccgcggcggccaggcgtttgttgaaggcgtattcgggctgtcccgaggcgctggtcgcgcccggggatttggggccgtggccggcatcgatggccacgatcagttcggccggtttgcagccggcccgggcgtttccgctcaagcccgccaaggcgacgagggctgccaggagcaggacggaaaacaatcgacatgaccaccgtgccgcgcccatcccataaccccctttcgggaggggccgggaggggctgagcccctcccggccgccggaggcattcttcgccttccttcttgcctaaatcatcttgccttcgctgcgcagggattccttgaggccggcgtcgaggagttcctcgggcgaggccagcaggtggtgcaggaagtcgctggttttttcgctgagccacgggtcgcgggccagggcttccacggcgcgctggcgttcggagcgcttgtcgccgggcatggacttgtcggcggccagcgcgcttcgcaggaactggaagtagaggctcgcgccgaagaccgaggccttaggatcaaggccgacgaacacccggtgcagatcgtcgcgggtgcgttcggcggccacggcggccaggaagtggaagggcgagccgccgcaggtgagcgcggcgaagaagtagcgcaccttgtagaaacgcttgcccgtggtaaaggcctgctccaggtcgtcggctgtgcacacgccttccacgcagctcgtgagtgaccggcggtagggcagctccatggcggcgacgatggtctgccagagcatgtagacgtttatgagcgtcatgatgagaatgctgctgctgcgcagggtcggattgacgtcgctggcccagttgaggaacagatagataaagatgaagatgaagatgaggtatttcgcgccgctgaccatcatgtgggggatggagcccatcttccagtgcaggcgaatgaccagggcgataaagacgataaacatgatcgtctggaagtatatgctcatgtcgacttgggccagttgctccagcatgtgcgtctccttggcgttgcggtgcgcgcgcgtcggcgtggcgcgtccgggccgaccgccggcccgtcgcgcgggacaggggaaatcttttccgtctgtgtaccttcgaggccgggccttggcaacggtcgaggccgatcttaccgcctgcaaatcggcccggccagtcgcctcaagcctgggccaggtggtcttccacggcctggatcttggccgtcagccggccggccgggccggtgcgccagtcgatgcgcacagccacatgaatgcgggaacagtccttttccagtgcttccttgcagcgggtgaccacggccagcacctcgtcccactcaccttcgatgctcgtggacatgggcgaaaaaacgtagggcaggccggattcgcgcacgatgcgaatggcccgggccacataggcggacaggctgtcgcccttgtccaggggaaagatggagaaatcgagaatggcgctcatggggcgtcctccttggttggggttggcgtttcgacgcgcacggtgacggcgtggctgcggccctggtcgtcggtgacggcgaagcggtgcgcgccgggagtgggccgccagaacagccggccgccgggcggtccctgggcggccagttcgccgtccacgtaccaggacaagcgggtggtggcggccggggcgtcggcggacagggtgatctgctggaagtcggccggaatgtcggggcgcacggcatagaccgtggccgggcttggcgagacgatgcgcggaccggctccggccgtgcccaggcagtccggggccaggggcgggggcgactcgaaggggatgcccgtcgaccgccaccaggacacgagttcgcccggatactccgtgacggcggcggtggtggcctcgtggccggcggcgcagtcggcggtgaggcgctcgccggtcttagtgtccaccagggtgcggcggtggatcgggcaaggggtcaggcggctgcggccggggatgatggtggccggcacgcgccgggggcagtcggggccgggcagctcgcggctgtcggcgcagacctcgatggtggccagattgagtccggtcctggccgccggccgcgaaccatagggttccagcgcccggaacagctcgaaaaggatcggcccggcatggaccgcgcccgagatgccggccacggctcggccgtccatgttgcccacccacacgccaatggcgtagccggcgcttatgcccacggcccaggcgtcgcggtggccaaacgaggtgccggtcttccaggccacctggggcacggccagggcgcgctcccaggaagtgggcagatcgggccgttcgacccgggtcaatatttcggtggtcagcgcgcaggcctcgggggaaaaaagccgctcggccctcgcggccggggcattggccagaaagacgggcggccggaaccggccgtcgtcggccaggcaggcgtagaggttggtcagggaggtcagcgtggcctcgccgccgccaaggatgagcgaaagcccgtagtggctggccggcttgtccaaggtcgtcaggcccccccggcgcaggaggtcgaggaagggggccgggccgacgtcgtttaaaagccgcacggccgggatgttcagcgaagtgatgagcgcctgctcggtcgtcacccggccccggaacaggccatcatagtttttgggcgtatagccgccaaagccggtggggatgtcgagcatctggctttggggaaagacgcggccctggtccatggccatggcgtagaggaagggctttaaggtcgagccgggcgagcggcggatggtcgcgccgtttatctgcccgaaccgggcgtcgccgaaccagtccacgccgccgaccatgaccctaacctcgcggctggccggttcgatgaccacggcggccacgctgccaaggccctgggcggccagccagcgggatcgggaccgcagcacgtcggtggcggtcttttgggcggccgggtccagggtggtgtcgatgcgcgggctggggccggcggcctcgcgggccatttgggcgaaatggggcgcggcgaacgggagttgggccaggcgcgtgggcaccggggcggcggcggcttccctggccgcttcggaggtgatgacgccgcgccgggccatggcggcgagaagcttgtcgcgggcggccttggccgcttcggggcggcgcaggggatcaaggcgcaggggcgagcggggcaggacggtcaagagcgcggcctcggccagggacagcttgtccggcgtcttgccgaaatagagggtggcggccgcgcccacgcccacgatgttgccgccgtagggggccatgttgaggtagcgctccaggatggcgtccttgccgagcttgcgttccagggccagggcggccagagcctcgcgccatttggcggccagggtgcgctccttgggctgggccagccgggccagctgcatggtgatggtggagccgccggaaacgacgtggccggccgcgagattagacagcgcggcgcggcccagggccaggggatcgacgccggggtggcggtagaaccgcttgtcctcggcggcgaggatgagtttcggcaggatgggggcgacgccggacaggcgcaccggaaagcgccaggattcgtccggggcgagatagaggcgcaggggctggccgttacgagcggcaacgaccgtggccggcggcggcgacagcgcggccaggggaaagggcggccgggccgtggccgcaaaaagggccagcccgccagccagggcggcaaggagcagcacggccgcggccacggccgcccgtcgccgccagcggggcgggcgtgaagccgttgcggtcatgggatcaaccctggtgcgcggcgcgcaactcccggagattttcgagcaggtcgagcatgtcgagctgcatgtggacacggcaggtgaattcctcgacctccaccggcttgaccaggaaatcgttggccccgaccttgaggaaacgcacggtctggccgccgccctcggccgaaacgccgatgatggccaggcgttccttggactttccggcccgcagttcctcgatgagcccgaaaccgtcgaggttgggcatgttgtagtcggtgatgaccagtcgcacgtcgtcgttttgggccagggtttccagggccttgcggccgtcctcggcttccaggacggtgatgttgagattgcgcagcagcccggtcagccgggcgcggaacagtttggaatcgtccacgaccagggcccggacgaactggttcttgtacagccgttcgatgaggcgttccatggcctccatctcggccatggacttgatgaaataatcgaccacgttttcttcaagcaggattttgcgcacctcctcggagaagctggcggtcatgaccaccgaggggatgccgagactcttggccaggggcacgatgcggccctcggggtcgtcgggcaggttgcggtcgaggatggccacgaagatggagtcgcgccgttcggtcatggccgcttcggcttcggtgaagctgtgggccactatggtgggaaagggcgtgcggtcggcgatgtgctggaagatgatcttggcctggacgcggctgtcctcgacgacgagaacgtggcgatggtcggtcatgctgctgccatccttgacgagggtatgatcctgtctggatacgggatggcggctgctctggcaagccggacggcgcgtctgcgtatcgcgttgtcccggcggcggcgagggtcccctttacgccaagtcgggggtccgggggcctgaggcccccggccgccggaggcatcttctcttattcttaccaatgtcgcgacatatacggctgcatctcgcgttcgaaggtggccgggtcggtggtggagacggtgggggccacgaaggcggtgggcgacaggccggccatggcccccaccgtggcatccatgggcagggtgcggctggacgcggcgatgatgttgttgtttctggcgtcgatgacttccaggttgaagcgcacgccgcccggggtgacgctgtaggtgccggccaggaccagggtggccgtggcccgggtggtggccagggccttggtgtcgcgggtgaggacgaattcgccctggctgcggctgaagatgatgtcgctggccttgcggatttcctggacattgtagcccaggcccacgaaggcggcgtagagttcctggccgaaaaggcgcgacaggggcgaagcccgctccaggttgttgaggtcggccggggtggtgatgaccagccagtagagtccccggctgttggtgggggtgcccatgcccaggcgcgggccgagctggcggtcgaggtcggcggccatggccatggccacgtcgggatattggggcggcggcggattcttgccggaaccgcacagggcgcccatgagcagcggcgacagcagggccgccagcaaaaggggcaaaaggctggttaagcgtgtaaggcgcatggcggactcctgttatttggcggccggggccttggcgggggccggttcgggcggaaaggcggccggcgcgggggccggttcggccggtttggccggggcctggcctgggaccttggccggttccgggtccaggggaaagatggaatcggtggcggcctcgtagcgtttttcgagcttgggctggctggggttctgggagaccggagccgggccacggctttctgtcggggcctgggccgtcggcggcgtgggtgcgtggcgaggggccttggcccgcctgggcttgcgcttgacgggcttggacacgaagggcttggccggcgtggagggcgtgggcggctggctcacgtcgcggatgcggatttgcgtgggcagcggggccggggtgtcggccagggcctcgtccccgccggccggccccgccagggccagggcggcgagcatggcccaggcggccggaagtttgcggatggcggtcatggcgtttcctccccgggaatgttccccgtgccgctcccatcggccggttcggccaaatctttacggcggcgtcgagttctccccggcttaaggacttgcctaagggcgcgagaagtgatttatggaaatacaaggttttgcttgtccccgccggccggcctcgcccccggctcccggcggacacccacgaacggggccctttaaggagtaaaaaatggctgaacaactcgaaatctacaagtgtgaactgtgcggcaatatcgttgaagtcctgcatgccggcggcggcgaactggtgtgctgcggccagcccatgaaactcatggccgaaaacaccgtggacgccgccaaggaaaaacacgtgccggtcatcgagaaggtcgagggaggctatctggtcaaggtcggcgccgtggctcatcccatggaagaaaaacactacatcgagtggatcgaactgattgccgacggcaaggcctaccgcgagttcctcaagcccggccaggctccggaagcctttttctgcgtcaaggccgacaaggtgtccgctcgcgagtactgcaaccttcacggcctgtggaaaaaggactagcccatgctgtcgccgaccatggaaaaggcgcttaacgatcaggtgcattgggaactctattccgcctacctctatgtctccatggccacctatttcgaggacaagggcctcatgggctttgccaactggatgcatgtccaggatcaggaagagaagttccacgcccagaagttctacaactacatcgtggaacgcggcggccgggtgatcctgcaggccattgaagcgccgccccatgactgggcctcgcccctggccgtgttcgaggacgcgttgggccatgaagagggcgtcaccgcccgcatctacaggctcatggacctggctctggaagaacgtgaccacggcacggcctcgttcctcaagtggttcatcgacgagcaggtggaggaggaggccagcgtggccgacgtcatcgccaagctcaagctcgtggaccagaccccgggcggggcgttcatgctcgacaaggacctggcgacccgggtgttcacgcccccgaccaacgcctgattgcctgccgcgttcacgcggcgcagggagggccgcccgcgcccgtcgcgggcggcccttctttttcgggcagccgatggcaaggctcgtggccgccggtccccgtggccgccggggttgtctttctgatgccgcttatgacccacttcgcaggagacggcgggcatgaacgtgaacctcaagtttttcttgaaggacaccatccgcaagatggtggatttttccaagaccgcccagaaccggggcctgccgccgccgccgttgcaaaagccctatcccctgggcgcggagcttgtccggctggccgggccggggcagtggcagggggtgcgcgatgtgcccgtggcccaggccatggcggcgcgcaaatcccaccgcagctttcgccaggagcttttcacccaggacgaactggggtttctcctgtgggccacccagggcctgcgcaaatccccggggctgaccggcgggctgcgcaccgtgccctcggccggttgtcgacacgcgtttgaaacctatgtcgccatttaccgcgtccagggcctcaaccccggcgtctatcgctatttgcccatcgaacatgcgctgatcgaggcggtcacggtggaggatctggaagaggaggtggccatggcttccttcaaccagggctttgtgtcgcggggggcggccacgtttatctggacggccgtgccggcgcgcatggagtggcgctacggcgaggcgtcctacaaggtcatggccctggacgccggccatgtctgccagaacctctatctggcctgcgaggccgtgggagccggcacctgcgccatcgccgcctacgaccaggaggctttcgacgccatgctggggctggacggcgacacggaattcaccatctatctcgctccggtcggcaaggtctgacccggtcggcgtcgttttgggggaggaggaaggaatggagagaaaagtcgtgctgttcgcctttcgtggcgacgtgtcctgtttcgtgcacgtgctccttaacgccatcgactaccgggagcgcggctacgaggccaaggtggtgctggaaggcgaggccaccaagctcgtggccgttttgtccaaggccgagcatcccatgcacgggcttttcgaaaagaccaaggggcaagggctttttgccggcgcctgccgagcctgttcccaccagctcggcagccaggaggcttgcgttaccgaggggctgacgctgcttgacgacatgcacggccacccgggcatggggcggtacacggaagagggctacacgattttgattttctaggcccggccagggatacgaacgcttcggggcggcccaaacgggccccccatctcatttcttgcgcttgaacatcttctccatctcgcgtcggccaaaacgcaccgtcaccggccggccgtgggggcagtagtcgcggtccgggaccgtggcccactgggacaaaagcgccacggcttcgtcggcggtgagccgcgtgccggccttgatcgccgtcttgcagctcatgagaatccacaaatcctgcaaggacttggactggccggccaaggcggcgcgcaggtactccttggcctggcccacggtcagctccggcggcgcgccggtgatggcggccatgcccggacgcggcgtgtccacgacaaagcccatggaccgcagttcggtgaaaagcgtttgcagccgggcctgctcggagggatgcagcgtcagctccacgggcatccccagcggccggctgtggccgcgccggccggccgcctcccgggcggcgtagatgacgcgttcgtgggcggcgtgctggtccaccagcaccagctcctcgccagtgtccacgatgagataggtgtcgtcgaactggcccaggtaacgcatgtccggcggcagggccggttccagctcgtccacggtcctggcgtacaggggcgcgccggcctcggccccgtcgttctccagggcggcctcggcggcggcccggcgggccacggccggcggatcgaaatggcgggccggcccctggcgctgggccggggcttcggccaccccataccccgacggccgggccggataggcctcctgatccgccggctgggccgacatgtcccgggtcgccccagggggcggcgcgaagcgacccggctcccggccaaaggtttgggccgcgtcctggtccggtcgccggccgtggggctggtgcgccgcccggcccgggccttggtccgccagcggcgcggccggccgagagcctgcccggccggccgccccgcccgccggttggcccgccgtctgggccgcgccctcgggcggggccaggggcggcagggtttcgtcaaaggagctgctgctgaggattcgcggatcgccgggcaagggcgcgcgttcccgcacggactggcccgaaggcgtggtctcatggggcgagggcgcgccggcccggccgagctcctcgaaaaagtcgcggcggctggcgaatttcggcggctcggccccggccttgacccagggttccggggccgggaccgtgcggtggacgagcgccttgtccagggccgcgcccacggcccggcgcagggtgaggaacacggcctgctcgtcgcggaaacgcacctcggtcttggccggatgcacgttgacgtccagatcggccgggtcgagttccaaaaaaatgacggcttgggggtattcccgggctaaaagccggcccttgtaggcctcgcgtacggcggcgagcagcacccggtccagcaccggccggccgttgacgtagaaatacatgcggtcggccttgccctgggcgcgcagcggcttgcccagcacaccgtggaccttggccccggcggcgtcgctggaaaattcgaagagatcctcggtgacggccggcggccagaaggcggccagccgggcgggcagggtctggccggccgggaagcgcagggccgtgcgtccgcccacggtcagcttgaaggccacgtcaaggcgagccagggccgctcggcaaaaaagctcggtggcccgtttggtctccacggcctcggatttgaggaatttgagccgggccggcacggcggcgaacaggtcgcgcacctcaatgcgcgtgccctgggccacggccgccgggccgcgctcggtgaggcggccgttttccacggccacgaacgcgccttcctcgaaagcctcgtggcgggagctgatgcgaaaccgcgacaccgaggcgatgcttggcagggcctcgccgcgaaaaccgaagctgccgatgcgttccagttcgtcgatggaggcgatcttgctggtggcgtggcgggtcagcgccaggggcagctcttcgggagtcatgccgccgccgtcgtcgctgacgatgacggcggtgcggccgccgccgtcgatggccgcctcgatgcggctggccccggcgtcgaggctgttttccacgagttccttgagcacgctggccggccgctccaccacctcgccggcggcgatctggttttgcagttccgggggcagcacgcggatggtgcgatgggtcgtcgaagctgtcatggcggggaatatacgatctttcgccgccccaggccacccgcgcgtttcgactggaaaaacgccggcgtcgggggtagacgggcgggtgtcccacgcaaaaggagccgaccatgcccatcgagcataattacctgcgcacccggatacgcacggaaaacattgtcgccaactatacgcgcctgcgcgcccagggcggtcaggtcgtcagcgtcatcaaggccgacgcctacggccacgggcttctcgaaacggccacggccctggccggggccggttgcgagagctttgccgtgggttcggcggccgagggcgcggccctgcgcgatgccggctgcacggcggaaatcctatcgctgcttggcccggtgctgcccgaggacgaactcttgatcatcgaaaaaaatctcgtgcccttcatgcacgacttcgaccagctggcccggctggccgtcgcctgcacgcgtcttgggcgcgtggccaaggtggcgctcaagttcgacaccggcatggcccggttggggttcgtggaggccgacgcgcccaaactcgccgagatgctgtgcgcctcgccctgcatcgaggtggtcatggtcagctcccatctggccacggccgacgatccgggcgccttcgaattcgtggccgagcagggggcgcgctttgcccgcatctgccaggccctgcgccacggcgggctgacgtttcgggcctcgctgtgcaactccgccggcatcctggcccatgccggggccatcggcttcgacgcccgccgggccggcatcgcgctctacggcgtcaatccctttgccggcagcgcccgcgaggcccttggccacggcttgctcccggccatggagaccgtaacccgcatcgtctcggtccacgacctgccgcgcggggcctccatcagctacggccgcacctacgtggccgagcgcgacatgcgggtggccatcgtggccgccggctacgccgacgcctacagccgggggctgtccaacaagggcttcatgtgcctggccggccggcgtgtccccatccttggccgggtgtgcatgcagctcacggccgtggatgtctcgggcctcgatgccgtacggcccggcgacgccatccatctgctgggcggcgagggaccgggcgcggtcacggccgacgacctggccctgtggtggggcaccatcccctacgaggtcttctgtctgctggggcttaatccccgggagcatgtttgatcggcgctttccctgccgccaaccaaggaagacggcatccggccatgaaacgccagacgctttttctcaatatgtacggggccatgctcgacgccatgggacccagcggctggtggccggccaaaacgcccttggagatggccgtgggcgcgatcctgacccagaacaccaactggcagggcgcggccaaggccgtggccgggctgcgcgaggccgggctgctcgatccgcatgtcctgcatgccgccagcctggaggccgtggccgagcgcatccggccggccgggcatttccgggtcaaggccgggcggctcaaaaacctcatggcgcttatcgtggaggagcttggcggcgacttgaccgccctggccggctacgatctcgatcaggcccgggacaagctcttgtccgtcaagggcgttggccccgagaccgccgacagtattttgctctatggcctgaacctaccggccttcgtggtggacgcctacaccgcccgtatctgcttccgccacggcctggcccccgaggaggccggctatgatgagctgcgtgaacttttcatggacgcgctgcccgaggacgtgaggctatataacgaattccacgccctgctggtgcgcgtgggcaacgcctggtgccggccgcgcgcgcccaaatgcgccgcctgtcccttggagcgttttttgcaatgaggacggcgcttttggcccttttctgtctgttggccctggccgggccgggacaggccgtcaaaccgccgacggttccggccaaggccgtgtcggcggcccaggacgcggccaaggcccgactggccgaggcccgggccaaggtggcggcccagtcggccgaggccgcccggcttggccgggaattggccgccctggaggccgcccgggacgccgaggccagacggcttgccgccctgacggcggccttgtggccgcttcgggccgagagtctggctggggcggcccaggccgaggattgggccgaggcggaccgccggttcgtctggacgcggtcgcttatcgaggcggccggcgcgtcgcggctggccttcgaggccgctgcggccaaggccaaggccggacggctggcccgggacgacgcggccttgcgcctgctggccgggcgcaaggaggccgacgtggcctttgccgccgccgtggccggccggctgcgcgagttggagacggcggcccaccagccggggcgcggcgacgaggccgccttggccgaggccctggacgcggccgccgcgccggatgacgccctggcaggcgtggccccggcgggcgaggacggcgcggccgggccgatggtcttcacgccgccgcccggcgggctggcctggccgagccaggggcgggtggccttgccctttgccccgtccggccgcgacgcccggcagggactggtgctggccgtgcccgaaggatcgcccgttgtagccgccgccgacgggcgggtggtttttaccggcacgttgcgcggcttgggccgggtgcttatcctggcccatgacgaccgctgccacacggtctatgcctgcctgtcagaaacgagcctcgccgtgggcgaggccgtgccccgccaggggcttatcggccgcagcggctattgcaaccagacgcgcgcccccggcgtctatttcgaattgcgttttcgggaaaaagcccttaatccggcggagtggctcgccgtcaggcgctaggctcggctgccggccggtttcgcggggataggcgttttcacccgaggccggcgtttcggtccgcatttcctggaggatggtatgcgtcttttgaccaaagtgtcctgttccctggccgttagcctggcgttatgctccgtcgcgtttgccgccaaacctgaggaagaccggttcgcgccgctcaagcgcttcagccaggtcatggatctggtggaaaaccactacgtcaagcaggtcacccgcaacgaactcatcgacggggccatcgtcgggatgctgcagcagctcgatccccattcgagctttttgtcgaaagacgaattcaaggaaatgcaggtcagcacttctggcgaattcggcggcatcggcattgaaatcagcatggaaaacggccgcctgaccgtcatttcccccatcgacgacaccccggccgacaaggctggcatcaaggccggcgacattattttggaaatcgagggcgagtccacccaggacatgaccctggtcgacgccgtgcaaaaaattcgcggccccaagggcaaggccgtgtccttgacactcgttcacaaggaccagcaaaaacccttcaaagtgaaagtggtgcgggacaccatccccatcatcagcgtgaaaagcaacgaagtggagccgggctatctctacatccgcctgacccgcttcaacgagaacaccaccgccgagctcaagcaggccctggccgactatcaggccaaaagcggcaagccgctcaagggcgtcatcctcgacctgcgcaacaaccccggcggcctgctggaacaggccgtcaacgtctccgacgtgttcttgccctcgggccagatcgtctccatcaagggcaagaaccaggagcaggagaaggtcttttccgccaagggcgacggggccgacgtggccgttcccctggtggtgctcatcaactccggctcggcctcggcttcggagatcgtggccggcgccctcaaggaccacaagcgcgccttgcttgtcggtgaaaaaacctttggcaagggctcggtgcagaccgtcatcccgctgtccgacggttcgggcatcaagctcaccaccgcgctgtactacacgccaagcggccgctccatccaggccgaaggcatcgaacccgacttcatggtcccgctccaggactccgagtccgaccgcgacaagctctcggccaaccaccagttccgtgagcgcgacctgtcccggcacctggaaaacaagaaaaagaaacccgaggcgacggacgatcccaagcagaagatgctcgatcaactcgcccgggacaaccagctcaagctggccctggaactggtgaagtatttccccatcaaaacctacgccccctaagaagcgcccagccaagaagggagccgccaagcccgccaaagggccaggcaaggctccccggcgctccggagccggagagaacaaccgtgtggttctctccggcaaacctgtttttacggccgtggccgccctggccctggtcgctacgcttgccgtgctcgcggcgctcctgtttggcccgttcccgtcgcccccgggcgaacgccaggcggccaagccgcctaagccggccgttggccagcaggcggctcgcaagaagcccgaaccgcccaagccggcgtccaagccgtccccggccgcgcccgaggctgcgacgcctcagggagcgcccccggcccccaccgacgaacacgacgccctgaccctggcccgggcgctgtcccaggcccaggcccaagccaagggcacgccgcccccggtccatttcgaggagcacctgccgccccaggccgcctcgcccgaaaacgggaacggcaatggcaacgggaacggcaatggtcctcacgaagtgcggggcaaagtcgagccgccggccggcgcgcaaccgccgccgcccgagccggccgccccgcccgtggcccgggatgaaggcaaaaatccgcgcatggtcgtggtcatcgacgacatcggcgaccatcccgtcatggccaagaatctgaccgaactgccgttttccgtcaccctggccatcctgcccaaccgtccccggacgcggtccgtggaggccatggccgccagccagcacgtcgaaatcattttgcatcagcccatgcagcccggaacctacccacgggtcaatcccgggccgggcgcgcttttcaccgacatggagcccgagcgcgtgaaggaaatcctggccgacaacctgagccaggttccccacgtcaagggcatcaacaaccacatggggtcggctttcaccagcgacccggccggcatggacgccgtcatggccgtgctcaagcaaaagggcctgtttttcctcgactccgtcacctcggccgtcagcgccgcgcccgaagcggcgcgcaagcacggcgtgccgttttaccgccgggccgtgtttctggacaacgtgcgcaatgtccgcacgatccttggccaactcaagaccgccgagcgcaacgcgctcaaaaacggccgggccatcgccatcggccatccctacggcgaaaccctggaagccttgaaaatctgggccaaggaacgcgacggccgcgtcgacgtggtgacgctcaccgagctaggacctgaattctagtgccgcgtccccgaaaagcgcctagggcgtttcgtgggcaacagcatacgatgcccgtttttcataaccacgacgttcgtcttgtttaagggacccgcactcccgcgcgggccgggccgcaagattttcatggacggcccgggccggctggccgatactgccgcccgggcgtttctccagcccgcgccatccccaaccgcctgccaaacctccggctttcgccgtcaacgcccatgcaattcaaacccgttttctacaccggcctgaccctggccgccctggccctggggcttttcaccacccgtctggagccggcccggcgggtggacgcctggtcgtcggatctgtggcatgtcctggccggcaagcgctacgaaccgcagcacgtggccgtggcccttttggacgacgaggccctggccgccgaacctgaccggccgctggttttctggggaccgctgtacgccaagatcctggcgaggcttcgcgaggtcggggccgtggccgtgggcatggacatccagccggcgctgagtcccgtcacctggatggacatcatcggggccgacgccagccgcgatttcgaccgcgacttcatgctggagctggccaagggcaaggtcgtcctggccgccagcgtgtccaccgaatcgggcgaaccgtcgtttagcctgccggctacggactatctgctggccttgccccgtcacgaggccgacctcgggctgaccaacgtgccgctggaccgtgacggcgtggtgcgccgcttcgccccggccttgtacagcgagggcgagccacgcctgtcctttgccgccgccttggccaaaaaaggcgcaccaggtatttctggcgcgccggggctggccggcctggatgaccggaccgccttgcagccgcgccccatcgcctacgccggcccccccggcacctttgcccatgtcagcttcgcccggctgctggccccggacgccctaagcgaccccaaggtccaggccctggccggcaagatcgtcattctgggcatcgacatccacggcgcccacgaccggctggcctcgccgtactccctgccgcttttcggcgcgcccaaggagttcatgcccggccccgagatccacgccaacatcatcgaggccatgctgaccggccgcaccctgacgaccgtcggcctcggcgccgcggccggggcctggctgccgtttctgggcctgtgttccctggcctgttcgcggcttgggccggggcgttcggccctggccgcgttgggtcttgggttgggagcttttggcctgggctatggcctgtttctggcagggcggcttctgcccctggccggcctggacgtcgggctggtggcggtctgggctggggccaacgccgtgcgcctcactcgcggcgagcgggaaaaagcccacatccgccacgcttttggcaagtacgtgtccgacgcggccattaccgccatcctggccagcggcaaaccgcccgcgccgggcggctccctggccacggtcaccgtgctgttctcggatatccgcgatttcacgacattaagtgaaaaactctcggccgaggaagtggtggagctgttaaacgcctacttcacccgggtctgcgacatcatcttggcccatggcggcatgatcgataaattcgtcggcgacgcggtcatggctgtgttcggcgcgcccctggctgatccgaaacatgcgcgccaagcccttgcctcggcgctcggcatgattactgcttcccatgacttcgagacctggatgcgcgagcgtttccccaagctgggggattggcgctttcgcattggcgtggggctgcacagcggcccggccgttgtcggcaacatcggttcccggcagaggctcgatttcacggccatcggcgacacggtcaacacagcctcgcgcctggaaggcgtgaccaagaccatgggctgccccatcgtggccagccgcatgaccgtgacaatggccgggccgggcgtcgccaccggccgcgaggaaatggcccgggtcaagggcaagagcgaacccgtgccggtcctggaaatcctgggactggccgatacatagaaaaggagttcccatgcgtcgcgccgtcgcgcttttcttgtttgtgatcctggccgtgggcctgtccggcggttatgccctggccgaagcgccgcgtctggtctgtctggtcgcggccgtgtccggccaggccagcctgtccccggctgacggtccgaaaaagcccttggaactctttacccgcctgcgcgagggcgaacgcctggagctggctcggggagccgaggtacagctggccttcttgcagctcggccagcgcgaaacctggaccgggccggccacggtgctcatcgccgccgccggcggccaaagccccaacgcgtccacgccgccggtggtggacaagctgccggggaagcccaagccggccacgggtgaagcctcgtcaattttaagccaggccggcgagcaggccacggcccaggtcaagacccgggaggtcaccctgcccgaggacaagcccctttccgacgaggaacgggcgcagctggccgatttcgagggccaagtggccgagatgcgaaagaccgccgctcccggcgacgtgaccccggacatcgcgcttttggaagaacttacccgcctgggccagcgtcgcaaggccctggaggaagtgcgccggctgcgcgaggcctatccggataacgccgctctggccgccttcgaggaataagcgctccggcggccgggacacgggcagagcgtgttgccccttcccgccggtcgccgccaggttttcttgcttcacgaggcggccgctaccgccccacccaacgcaaacggccggcccgggaacctccgacaggtttccgggccggccgcgttttgcggtcggaatgcgccggctattccttgaccggcaccacgtggatggccttgaccacaagcagcacggcatcgcccggggccagggccaagtcttccacggattcggtggtcagcaccgacgccatggcgtggggcacgtccacgctgaagttgacctgggtcatgacgtcaccctttttcacggaagtcaccttagccggaatctggtttctggctccgtagcgcatggtcgtctccttggcgttagagatttgtggacgtgaaatatgttgtgttgtgaaaggatcctgtttgttgttaaaaattttctgatgtcatttgcagggtgttgttggcttgtgctgcaatttctgaaaacacgtagtcattattaaaataaagcataagcgatgattgttcttgagaaagtatgcgccagtctcaggggttggcacgaatgtcgcgtcccttagaaaagcgatggtatttcaacgaaaaaacaatggttttagtctgttgtctgcgaaatgtcttctgtgcttttcgtggacgcgacactagacgcaaaccatgttgcggccctgggctttggctttgtagagagcggcgtcggtttgctggagcaaaatgtcggcagacctcgtggctttcgtcgtgcttgcaattccgaacgatgacgttatccgaaattgttccgatatattcgggccatcgaagagcagattggcgatttcctggcgcaatcgttcagcgatgtcacaagcgtggttggcatctgtgtcgggcaggatgacgagaaattcctcgccgccgaaacggaacaactcgtcgtagcgccgcaggctcgactttacctgactccccacctgagcaaggactcggtcgccgatgacgtgcccgtaggtgtcgttgatggccttgaagtgatccaggtcgaacaggatcagggaaaaggtttcgccggaactgctgcaccgggagacgtggtgatgcagtcgcgactgcatatggcttctgttgtatgcaccggttagaacgtcgatcttcgagcgctcgatgatttcctgggtggcctgggaaagcctggactgggcatccatgaaatcgaggaggggaaagcagaggatgagcgcgtccaggcaaagcatgttgccaaaaagaacgatggcggtcagctcggggccaatggcgtcaagggccgagcccggggaaagccagccggcgcacaggatggcggcccggataaagagcgttgacgccagcagcaggcaaaagccgtgcatcgaccagactacggcgttgtgcgggcgggtttttcgtatgatttgcagcgcagcgtacagatacagcgcgccgtttatggccgaggtgtagatgcccggtaagtgcttgtcgtgcatagtcagggccaacaccccaaaggaaaacgcgaaaatcgaggcaacggtcaggctaaagcgcagtgtgggcggctggcgggccagtgaaaagaccgacagggcaatgaagataggcagtgaaaagatgcacaggttggctataggcagcgagacaaggttgatgcctgtcatgaaacgcaacaggaaaagagcccagcccagggaaaatgcgaaacaaccgaaagccagaatcgaaagatagttgtggcgtctgatcttgtgcagaaccagcaggaataaacctttgatgaaaaagctggcgactgccagactgatgacggtccttgattggaaaaaaaagcaagatttcgtttatattcatagttttacccaggtctaccgccgcctgctgctgcctcacgtgaagcatactggaaaaagatacgttttggaaacggcctgcctgggctccctcaaggtccgggtttacgcccctggccgcgtttgtctccagtcgctgcgcggcgcgtgtcgggcttgccggacctggtgtccggccgtccgcgcctgccgtccgccttgccctggcggagcggcggcgcgtcgcggcgaggaggtgcgggtgcgcccggcgcgcggcggtccggccgccggtcgggctggcccttgctctggccggccagccgcttttcgcgctcgccgccgagcacggcgtgctgccgcaggcgctcggcatcggcgtcggcgataaaaagcggctgcccgcccaggtccgtgccggcgaaatacatggccgccgccgccgtgccgggcagcgggatgaagcactgcacctgattgggccgccagcccttgccggcgaaccactcggccatgcgccgcatgtcctccagggtgcatcccggaaaggcgctcatgaggtagggcaccacgtattgctccttgccggcccggccggattcccgctcgaagactttcaggaaccgctcgaacacggcaaagggcggcttgcgcatgagcttgagcacccggtcgctctggtgctccggggccaccttggcctggccgccggtaaagcgccgcaccatgcgccccagggcgtcctcgtcagccagggccagatccatgcgccagccgctggccacccgcacatggcgcacgccagggacttccgccaccgcttcgagcaggtcgacgaacgcgccctggtccacggaaaaatgcttgcagatggtcggcgtcaggcagcttggccgctggcaggatgtcatgtccccccggcagcgcccgccccacatattggccgaggggccgcccacgtcgctcaccgacccgtcaaagcccggcgcgtccaccagccgggccgcttcgcgcaggaccgatccggcgcttcgggagcggatggcccgcccctggtgcagggccagggtgcaaaaggagcagccgccggcacagccccggtggatgttgaggctgccgcgaatcatgtccgccgccgggatgggcagcttgtaggagggatgcggctggcgtgagtagggcagggcgtagagggcgtcgagagtcttgccggaaagccccgcccctggcggggtgagcacggtcagccggtcgccgcttggctgcacggcaagctgcttgttctggtggacgtggcgctccagggccaaggtcgcctcgatgagccgcttgggatcggcgacaatggcctcatgggccggcaaggtcaggacgtcggcctgcgggaaccgctggggcagctcctcgggcttgagggaaaaggccgcgccgggaagtccggccaggatgtcggccagtaagcccccttcgtcctccagccggtccagtccctcggccagggccaggatgccggtctcggccatgccgtagagcaccaggctggccttggcgtcgtaaaggaccgagcggcgcagggcgttggaccagaaatcgaagtgggacacccgccgtagcgacgcctcgatgccgcccagggccacgggcaaccccgggaaagcccggcgcacgaggttggcgtagacgatggccgcccgattggggcgcgcgccggccttgccgcccggggtgtaggcgtcgtcggagcgttttttgcgaaaggcggtgtagtgggccagcatggaatccagcgacccggccgtgacgccggcaaacagtcgtggccggcccatggcggccacgtccgccgcgtcgccttcccagcgtggctgggccaccaggccggtcttgtagccgtgggccaccagccaccggccaagcagcggcgcgccaaaggacggatggtccacgtaggcgtcgccggtaacgagcaggacatccaggcagtcccagccgagagcgtccatctcggcccgggtcatgggcaaaaaatcgggttgcgtcaggggcgtgcgtgccatggtcgcagtatggccgcttgggggcgacaggtaaagcgcggtttcgcggccggccgggagtctcccgggattcccgggaagccctcccgggcattcgggagatcggcccatggacacccgaccggctgtcctgtgtattacggcggttttgttccactctacgatccgccaggagagaccatgcgcaacttgtccaagaccaacgacgtcctcggcacgaccaatcgcggcaatgtcgccccgtccgggctatgcaccctgtgccgcgccgactgcgccggcaaatgcgaaacatggctgtcgagcctcaagggccgggccatgctctatccccgggatttcgggatcgtcaccgctggcagcggcaacaccgaacacgtgggcgtgagctacgacgccctgcgcatccagggctacaactacggcgcttacgccgtggccgccgggcgcaccaccaatcccgacgactgcctgttcaccaacgtgaatctggaaacggcctttggcagcggcctcaaagcgcgcctgccgcttatgaccggggcgctgggatcgacctttatcgcggccaagtactgggacagcttcgccataggctgcgctctggccggcctgcccatcgtcattggcgaaaacgtggtcggcgtggaccgggccgccgtcatcgagaacggcaagatcaccgccgccccggaactcgaccggcgcatcgacggctatctgcgttacttcgacggctacggcgcggtcatcgtgcagctcaacgtcgaggacgcccgcaacggcgtggccgagtacgtggccgacaagtacggcgacaaggtggtggtggagctcaaatggggccagggggccaagaatatcggcggcgagatcgaggtgaaaagccttgattacgccctgttcctcaaaaagcgcggctacctcgtggacccggacccgcaggacccggccgtggtcgaagccttcaacaacggcgcggtcaaggggttcgcccgccattcgcgcctgggctataccgatcttcccggcaacgacgccgtgcgcgaggcttttgccgccaacgtcgcctatctgcgctcgcttgggttccgcaacatatcgctcaagaccggggcctacggcatggaagcgttggccctttccctgcgctgcgccaccgacgccgggcttgatctgctcaccatcgacggggccggcggcggcacgggcatgagtccctggaacatgatggagacctggggcgttccttctatcctgctccacgccaaggcggccgagtacgcggcgcttttagcctcgcgcggtcaccgcgtggtcgatctgtcctttgccggggggctggcccgggaagaccacatcttcaaggccctggccctgggcgcgccctacgtgaagctcgtgtgtatgggccgcgcggtgatgatcccgggctttttgggttccaacatcgaaggcgcgctcaatcccgcccgccgcgaggcggtcagcggcaactgggacagcctgcccaagaccgtcacggacatcggccgcacgcccgaggagttgttcgcggcctatgccacggtcaaggaaaaggtcggcgcggccgagatggcgaacattccttacggggcagtggccatctgcaccctggccgacaagctcggcgcgggactgcagcaactgctcgccggagcgcgcaagttcgcggtcacgtccatcgaccgccgcgacatcgcctcggccaaccgcgaaaccgagcgagaaaccggcgtgccgtttatcacggatgtgcaggacgaggtggcgcggggagtgctcctggggtagactgcatgctctaacggcatgattctctggacgtaaagcccggttcaggccatggcctgaaccgggcttttatgttgtttacggccatgcagggcaaagcggcgtggagcaagaacgctgcggaggataggcggaagtgactgcaatgtcagtgtattgtgttcaagcaactgccgtcgctactcttgtcgggaatttacgggtcacttctgccgtaggctcgccaagagtcagcgattttagcgccgatcgagctggagcgatcagcagcccaggctgtttccttttgttggccagaagcgtatgttggatagggttggcccaggccatgatttcattgtcgcctggaaatgttgcggttgaatcaatccccaggtctccgtttgagtcgtttggtcgtgttgccgttgacggtgaggaacggtctccttgcgtaaaagaggggtcgcgtgcattgactggatagccacgtggagtattatcatggtgtaataatttaaaagacagatttttgtattgtatcagaattgtagcgagtatatcggatgtagtaagatgttcatgtgtaaggcaatagaagcatggttttcaaaggagtgcaatatgcttgattacgaaaaatcaaaagaggaattgattgcagaattggttgccttgcgccaacgtcttaaagatgtagagttgtcattttgcactattgggagtgttgaatacaagcgatcaaaagaagatgccgacttttatttgacgattcttgatgaagcgccagcattgatttggcgggccgcgaaagatgccaagtgtgactggtttaatgcgacatggcttgcctttaccgggcgtcaactttctcaggaaattggcgacggttgggcggaaggggtgcatcctgaagattttgatcggtgtctggcgatttacctcgaagcgtttcatgcccggaaattttttcaaatggagtatcgtcttcgtcggcatgacggagaataccggtggattctcgacataggatgtcctttcaaggacgcaaagggtgaatttgccgggtatattgggtatgtctatgatatcacggaccggaaagtgaatgagcagtttcgtttggaagtcgaaagaatagtgcggcacgacatcaaggctccgctggcaagccttcacactctggctaagactgtttttgaagatgggatagacgaagatattcgccttctcgtgccaggaatattgagagctgtgcagcacgtcatcagtttggtggattctactgaaaaagttgctatgcttgaattaggaaaatacagaccgcactcaaaatggttcagtattaaaaactgtatacatgatgccgttgtttgtttgtcgcccatagcagacatgaagcaaatatacatagaaacaaacttcgatgattttgtaaaagtgaatgaccgttgctttggagaagaaatccttgtgcaagatatggtcacaaatattttaaaaaatgcgctagaggcgtcaccgagagggaagtccgtaacaatcacgtgcatatgttctgatgttgatctgcatatccttgttcataatcacggagctattcctgaaagtataagaaataatttttttgataagtatattacgttcggaaagccctttggcacaggtttaggcacgtacagcgccaaattgatagcggaagcgcacggtggtcaaatcagtttttccacgtccgaggaagatgggacgaccgtattcatctccttgccgatccccgaacaggatgcagcgaggctcgcgccgcgataaaggaaaccgccccgggcgaggaaaaaatcctcccccggggcggcctttcaaaatcttctctcgtcccgaattcttacttcccaaacaaccgcttcttgccgtcgatgagctcgttcaccacgctcggatcggccagggtcgaggtgtcgccgaggctttccacttcgtccgaggcgatcttgcgcaggatgcgccgcatgatcttgccgctgcgcgtcttgggcagccccggggcgaactggatcacctccggcgcggcgatggggccgatttccttgcgcacatggagtttcaaacccttgagcagctcctcgctctcgtcgtagccggctttgagcgtcacataggcgtagatgcactggcccttgatgtcgtggggcatgccgaccacggccgcttcggccacggtcgggtgcgacaccagggccgattcgatctcggccgtgcccatgcggtggccggagacgttaatgacgtcatcgacccggcccatgatccagaaatagccgtcctcgtcgcgcctggccccgtcgccggactcgtagcagcccttgaacgcggcgaaatactgctgcttgaagcggtccttggccccccagatgccgcgcagcatcccgggccagggcttgcggatgaccaggaatccgccctggttggggccgacttccttgttttccatatcgacgatggccggatcgatgccgggcaggggcagcgaagccgagccgggcttaagcggcgtggcgtagggcagcggcgaaatcatgagcccgccggtctcggtctgccaccaggtgtccacgatgggcagcttcgagccgccgatgtggtcatggtaccacatccaggcttcggggttgatgggttcgccaaccgacccgaggatgcgcagcgacgacaggtcgtgcttctgggtccaggccgggccggacttcatgagcgagcggatgaccgtgggcgcggtgtagaagacgttgactttgaatttggagcagatctgccagaaccggtccggggccgggtaggtgggcacgctctcgaacatgagcgaggtcgcgcccagggccagcgggccgtagacgatgtaggaatggccggtgatccagccgatgtcggcggtgcaccagtggatgtcgtcgtctttcaggtcgaaaacgatctgcgaggtgtgggcggcgtaggtcaggtagccgccggtggtgtggtagacgcccttgggcttgccggtagagccggaggtgtagaggataaacagcacatcctcggcgtccatggactcggccgggcaatcgccctcgacgtcgtggtcggccatgacgtcgtgccaccagacgtcgcggccgggctgcatctccacgtcgttgccggcgtggcgcagcacgatgcatttatcgatggtcgggcattccttaagggcttcgtcggcgttgggtttgagcgggatggtcttgcccgagcggatgacggcgtcgctgacgacgatgaccttggattcacagtcgttgacgcggtcgcgcaggctatgggccgagaagccggcgaaaacgatgctgtggggcgcgccgatgcgggcgcaggccagcatggcgatgacgagttccggcaccatgggcaggtacaggcttacccggtcgccctttttgacgcccatcttcttgagcacgttggcgaagcggcagacttcgtcgtggagcatctgataggtgtaggtgcgcacgtcctcgtctttttcgccctgccagatgatggcggccttgttgcggcggccgttggtcaggtggcggtccaggcagttgtaggcggcgttgagcttgccgccagcgaaccatttgatttcgggggcgttgaaatcgtattcgaggaccttgtcccagggggattcccaggtcagcaggtcggtggcgcgctcggcccagtagccctcggggtcttcgatggagcgtttgtagatggcgcggtattcgtcgaggcttttgatgtaggcggtgtcgcgtccggcggcgggcggttcgaaggtgcgtccttcctgctggaggctttggatattgtcggcggtcatggattcctcccggttgggatttggcgtcgcgtatgggggcacagtgccgtaaagcgcccggcccgaaaagcgtaaatcggccaatggcggaaacaatccaataatcgtatcgggcttgggacaaaagaccgttcaccgagaaatcgacgccgtttaccgaccaaccccgaagccggcgcagatttgccctgggggtgcgactgtcggggcggcttcctttcgacgcgcggccgttcgccgccagctttccgcaaaaagaaaaagccggcgcggggccggctttttcagatatacgccagaaagcggagcactcgtacaagcttggagaagaccgggcggacgtacggcccgaaaccctgccgcctcgcctacaccggcgaacgtccgtccaccgattgccgccgcagcccttcaccccttttcccctttggggggtccgggggcctcaggcccccggccgccggaggcatcttctcttttcttctcttccctctctactctcgccttattccgccgcgttctcggcggcttcgtcctcgggcttgacttctggttcgatgtgttcgctccagtagatgagccgctggcagttggggcagctcaggatctggatgcccttttgcaattcgatgaacgactggggcgggatggcgatatggcagcccgagcagatgccggcgtggacgggcacgatgaccgggtttttcaggcgcgagcggatgaattcgtagcgctggaggatggggcggggcacggcctggccggcttcgttgcggcgtagtccgagttcgtccaggcgggcctgggcctgctggatgcgggcgtcgaggctttcgcgggccacgaccagttcgctgtcgagttccttggcctggccgtcgatgtcggccagctcctggttttggcgggagagttcctcggcgacggtggtcttttcctcttcgcggccgcggttctgcttttccagattgtccatctcgcgcatcatggcgtgatattctttctggttgccgaccatcatcatcttgcttttgctctttttgagccgcacggaatcggtttcgatttcgccgtccaggcgtttttgctggtcggtcaaatacttgagcttgtcgcggacgagctcggcgctgtcctcgatgtcctggcggcgcttttcgagctcaataatctgttccggggcccgtttgagttcatcctggagcaggacgatttcgtcgtcgaccttctgcaggaccacgagctgttcgatctgtttcaaatacatgactgtctctccgagtggttattcgtcccgggcgacgtggtcgtccgggcggcaggcggccatggggtcccgaccagggaaatagcggacttcgggaccgtcagggccgcattcggcggcaagtagggcggcgaaacgccgcatcatgacctcttccagggagaaatgcccgacgtcgatcaggcagcgtccggccggcacggcctgggcttgatggtacttgagatcgccggtgacgtagacgtcggctccggcggcaaaggcccgcaaggccatgtcggccccggagccggggcagtaggcgaggcgggaaatccggtccggcagcgagccggccagggtgaaaaaggcacgcggcagcagttcgcccagctgcgccagcagggcctggggcgcgacgggcgagggcagatcgccgacaaggccgtagccgtagacttcggccggctctgtcagctcctgcacggccgcaagcgcagcctcgggcacggcggccagggcggctgcctgggctgactggcgcagccggggcgggcagacggcttcgatgccgtccgaccccaaggcaaaggccgtgactccgggcagggcggccagggcggcctgcagggcctcggcgcggcccttggcggcaaagcgcagggcgaggtgcggcacgcggccggccggttcgaggatgcggcgtccggtcagcgccaaggcgtcggccagccagccggccgggccgtcggtgaccacgtccagggacgtgtgggcgctgtagagggtcgccccgctggtcaggaccagggccaggacgcggtggtagtcgtcgaggcggtcgggcaggcgcggggaaagggtgagcggatggtgggccagaacgacttcggccccccagtccagggcctgctccaccacgtccggcagggggtcgagggtgacggcgaggcgggtgcaagcttgggcggttccggcgatctggacgccgctgcggtcccaggaggcggcccgggccggggcggccacggcctcgatgcgggcgatgaggtcggctacgcgcatgggagaacgcaaaaggcgcttttttgggccgtgtcggcaaaaaagcgcctctggaggagccctttggccgccgcgcgggcggtggcggagggcgtataggaaaaagcgacgattgctgtcatggaaccttcgtcgtggtgggcccaccaggattcgaacctgggacctgccggttatgagccggtggctctgccaactgagctataggcccatgccgcgatagcgaactggtattgatacgccgtgcgccgtgaccctgtcaagacctggcccgaccgcaacacacacgctggccgccgcgcccatgcagggagggtccgggaggggcttagcccctcccggccgccggaggcattcctccccgcttatttggcgtccttgccggcgcgttccttcacatgggcgatggcggcgcggccggccttggccccttcgcccacggccacgctgatttgcatgaaatggcccacgcagtcgccggcggcgaacacgcccggcacattggtcttttgctcgtggtcggcctcgatgaacgcgccccgggtggcgacgcccagggtcttggcgaaatccagggccgatgcctgccccatggccacgaaaaggccctcggcggcgatttcggtcccgtcctccagggtcgcgccggtcatggccggctggccggagaggcgcacgatcttggcggtggagacaatgatgccggcttcggccaggctggcggcgaaccgctcgtccatggccggctccttgccctgggtgtagatgacgacgtcggaggtgaaattggtcagttccagggcttggttggcggcgtagttgccttcgccgaccaccaccaccttgcgggcccggtagaaaaagccatcgcagctcacgcagtaggacacgcccttgccgtcgtagtcgccgatgttggcgatgccggggcgcacccggttgacgccggcggcgatgacgatggcctcggcctcgatttcctccttgtcggtgacgcagtggaagccgccggtctcggtcatgtgcacggccagcacgcgttcgcaggcgatgcgcgcgccaaagcgctgagcctgcttgacgccgcgttcgatgagttcgcggccggaaatggtttccgggaagccgaaatagttgtcgatgtcgtaatctccggcgattttgggttcgcagccggcgacgagtgtttccatgccggcccgggccgtgtaaatggcggcggaaaggccggccgggccggagccgatgacgagacattgggtcttttgcatgttgccgtctcccttgccttgccgcgccgcgtcggaaaaaaccggctctcggccgggaggcgtggcgggcatggcccttggccgcgccgcgttgtcttgggcgcaaccctggcgtagaatgcgcactcgacgagcgcttggcaagccccgaggccaggaagcgcaaccccgcaaaggagccaggcatggccgatacgccgtccattgatcccgttttgtccctggagctcgtgcgcagcctctacgaaaaagcgccggtgatgctgcattccctggatggccaggggcggctgctgtcggtcaacgccatgtggcggcagaccttgggctatggcctggacacggtagtcgggaggtcgtttggcgatttcatgaccccggcctcccgggccgatttcgaggccaccatgccgcgattcgtgcgagacggccgcctcacggacaagccgtaccaacttgtggccagcgacgggcgcgtcgtcgaggtgttactttccgccgtgggcgaatacgacgtcacgggggactttcgacgctccttggcggcgcttgtggatgtgaccgggcggcggcaggccgaggaggccttggccaaaagtgaggagcttttccggctggcttttgaaaacgccaacgaaggcttggccatcgtggggctggatgggcagtttttgcgggtcaacaaggcactgtgccggtttttcggctacgaggccgaggcgctgctcggcaagaccgtgggcgatctggccgccgagggccacgaagcggtcagcccgcgtttcatttccctggccctggccggggtgcgcgaggagtttcgtttcgaaaagcgttaccgccatgccctgggcgaggaggtctggggacaggtctcggccaagctcgtgcgcagcagcggcggggagccgctgtatttcatttcccatctcctggacgtgaccgaggcgcgccgcactgcggcccggctcaccctgcacgccaacaccctggaggccttgctgcgcctggggcgtatgcgcggggccaacctagccgcccttggcgagttcgtgctctcgcggggcgtggccttgacggccagccagagcgggcttgcggccatgtccgacccggcgacaggccgctttgccgtgttggctgccggcagcgaggccctggccgtcttcgggcttggggaagggacgcgggaattcgagctacgggactcgccgagcctggccatggccgtgggcgacttgcggccagtggtgtcggacacgccctgcagccggctggccacggcccttcgcggcgacggccaaacgtttattctggctgtggccggccgggccatgccgtatggcgacgacgacatcaaccgcctcacgctccttggcgaaggcgtgttgcgccacgtcaaggaacgccgccgcgaggaggacctgaccacggccagacgccaagccgaggcggcaagccaagccaagagcggctttctggccaacatgagccacgagatccgcacccccctgtccggcatcatcggactcacccagatgaccctgacccaaaaccccaggccggagatccgggaaaacctggaactgattcttgattcctcccggtcgcttctgggcatcgtcaacgatatcctggatttttccaaaatcgaggccggcaagatggaattcgtgccggtggacttcgacctgcgcgacaccctggatcggaccatgaaatcgttccagttctcggcccggcaaaaggggctgaccctgggggtgcgcattgatccgcaggtgccggccatggtccatggcgatcctgaccgcatcatgcaggtggtgcgtaatctggtcggcaacgcgctcaaattcacggaccagggcgaggtggaagtgacgttgtccctggcccggccgggcgatcccatgctcgtttcgtgcagcgtgcgcgacaccggcatcggcattcccgaggaccggttgcacgagcttttccaggtcttttcccagctcgaatccacccgggccaagcgctacggcggcacggggctggggctggccatcagccggcgactggtggagatgatgggcggggccatcgacgtggagagcgtgccgggccagggcagcacgttcacttttaccgtgtctctgcgcccggctgccgaggccgcgcccgaaccggcacgtcggaccgccgccgcccaggccggcggattcgccggcttgcgggtgcttctggccgaggacaaccaggtcaaccgccttttcctcaagcatttcctggccgaggccggctgtcaggtgcgtctggccgggtcgggcctgcaagccctggaacttttgtgtcaggaaccggctgacctcgttctcatggacatccagatgccggagatggacggggccgaagccacccgacgcatccgggaaggcgaggctggagatgcagcccgggcaatgccggtggtggcgctgaccgcctacagcatgaagggggaccgggagcggttcttgtcggtggggttggacgactacgtgtccaagccggtggacgtggacgaactgttcatggtcatgcgccgggtgttggcccgtccggtcgagccggccaaggcagccgtgacctccgccggggtcatggaccttgattattacgagcagcggggcaagtcggcctttgcccgggaaatttgccgcatgttcctggaggagagtccgcaggtggcggcttctttggaaaccgccatgcgggaggcgaactgggaggcggctggcgacgccgcccataccctgctcggcatggccgtgccgctgcgggccagggggctgaccgaaggcgcgcgcaagctgcaagaggccggcctgtccggcgactccgcaggctgccgcgacgcctgtcggctggtggtggaggagttgggccgggtccagacggccataggcgagttgctcaagtaaacgccacatggcacgccacaacaaagccctccctggtttgagccagggagggcttttgcataacttggaaaaaagcatttaagcaggcgacccaatgctggatgggagtgtgatcggttcggttatttgtagattcatggataattccatgttgagagtcaataataacgacactataatcattccaattgtacctgccttgttttttgtttttgcttcgttgtttgttttctttgggggcttcgtggtgtgtggcactgggtgcactgtctcaagcggttgcgcctgcttaaaggcttttgtgtgattataaagcatttttttatgagtaaataggattgttttatattaaaaaagtcggtcgtttattttaagttaaacgtatccgtagcctcacctcctgccttgatgcaaattttttctgtcagggagggtccgggaggggcttagcccctcccggccgccggaggcactcttttctttgattattacgccatcttcatgaaaaacgccggcccgccgtcgctgccgccggccaggcggcggccgtcgggggaccagacgaggttggtcacgcggtggctttccagggcgaacagcggcgcggccccttggcgggaggcgctgccgaggaacaccacgccgccgtcgaagccgccggccaccaggggcagggcggggtgggcggctacggccccgagcatgccgtgctcgaagatgccaaataccgtggcctcgcgggtggccggatcaacgtccgcgcccacgggccagccgacgaaggcgcgttcgccgccggtccacagggtgccgccatcgctggaaaaggacaggcagcgcaccttggccgggtagccttccagcaggtagccggcggactgggccagatcgtagacgcgcacggacttgtcctgggtggccagggccatcttgtcgttgtccggggagaagaccacggtgaggttggagccggccccttccagacggttgccgggcgtgccggggcgcggcggggcgtagacggtgacgccgtcgtagtggctggcggccagggtgcgaccgtcggggctgacggccaggccggccacggcgctttgcagttccggcaggggagccggggcgaagtcggggccggggaagagcaccacctgcttgcccacggccacggccagcacccggccgtcggggctggcggcggcgtgttcgacccactggccggggaaggcggccagttcgcggcagccggtttccagggtggtcaggacgacccggccgtcgtcgccgccggtgagaaagccatggggcgaggcggccagacacagggccgcgccggtgtggggcgcggcgaattcagtctcgccggtctcggcctcgaccagggcaaggcggccgtcgcccagggcataggcaatggtttcgccgtccggggaaaaggagcaagcggcgacgtacgcgccgaaatcggcccgcatgaggcctttgagttccgcgtcgggagtaaacgtcatggccctaggcctccttggccgcgcaaccggcgaggccgtcttcaagggatttgcggtccaggtcgcggccgatgaacacggcccggctctggcgggtttcgccctcggcccagggcgtgccccaggcggtttccagatacatgtgcacgccatggaagataaagcgctgcttggccccggccacggccaggatgcccttggagcggtagatgtcctggcccttggaggcaagcagcgtgcgcaggaattcgccgagcttgtccgggtccaggggggcgtccagggtgaagcttagggactggatgccatggtcgtggacgtgaccgtgctgatggtcttcctcgggccggtagggagccaggccgcccggggcagacccggccgccggctggcccaggggcaggcggctcaaatcaaaggcgttgcggtcaaggagcacgtccatgggcacctggcagcgcgtggtttccagtacctgggccgtgtcgttgatccgggagatggcctggcggatgtcggccagctcggcctcgggcacgaggtcggtcttgttgagcaggatcaggtcgccatagacgacctgttccagggcctggcgattttcggcggcgtggcggcgaaaatgcagggcatcgaccaccgtgaccacggagtcgaggcggaaggcgtcgccggtgtcctcgtccatggaaaaggtctggatgatggcggcgggatcggccaggccggtggtctcgaccagcacggcgtcgtaggctccccggcgcttggccaggccggacagcacgcggatgaggtcgccgcgcacggaacagcagatgcagccgttgttcatgaggtagatctcctcgtcggaggagaccaccaagtcgttgtcgatgccgatttcgccgaattcgttgacgatgacggcgaatttgcggccgtgggcctcggtgaggaggcgatttaacagcgtggtcttgccggccccgagaaagccggtgagcacggtgacgggtacggatgccatgaaaaacccccggggttggtctacggaccccggggggtatcaccaaatcggccgaagggccagtcgtcgggaagggccgggaaggtgtgtctcgcccctttggggacagggcattgggatcgtgctgcctgacgccgttcgactgtgtctcgggggaggcgcagccggcccggggtcatgtcccgaagcgctcagcgcctcccgggaccggcctagtacggccggggttactggagccggccataggccagttcgaattcgaccagttctcgaccgcgctccacggcgcgggtttcggtgttgccggccacgccgaggtgatggagcagatgtccctggccgtcgcggatgtcggcggcgaaggaggcgcagtagtcgccgcgcggggtcaggtcgatggagaaacccttgtagtcgctatgcagggaggtgttcatggccttcctcctttttgataagaatagtcattatcttttaattggcaagtaggagaacgacggcagtaatgccgaaaatggcaaaaagaacgccgccccgtggagagacggagcggcgcatggtccgcgtcgggagagggggggccggcgcgggccaaatatcagccggattttgccctcatgtgcaaaacccctctccggagcgtcgggttagtcttcaactttgccgatggtggtgacgcagcagattttgtcccaggagtagtaggtgttgcaggtttcctcgccctgtttgacggtgacgcgcacgaactcgtcgccgagaaagagcgtggcggcttcgtggatttttccttcgttgatctggattttcacgcctttacggagttttcgggagagcgtcccgtggactggcgaggaggcgtactcgaaaactttttcgagggtttgcttctgcatgatttttagctccttttgacaaatttcgagaaatctctgttcggttaccccttaacccttctggggtaaaaatcaatgtcaaaatgactgaggccaggggcaacccgtgactgtgaaaaaataccattatatgatggctttggtgtcgacttctcaaatagggtgcgatgttgtgtccggcgcgaaggcttagtcagatgttggcaggaaattgtgacattaatgacgatgccagtttcgccgtcaaatgacgtcagaaagcgccaggaaggacccagggcgggaaagccgacggaaagcgcggttggcgacaaccgaccgccggaatgccgtcaaggggtctgcttggtacggggcgagcctggggagtgaggccggccggatggggtgttcgccggcggcaaaggcgttcacccgtcccgccgggaaggcgggacgggtggtgggaggcggcgggcaacgccagcagggacgccggcccaggggcggccggagccgtcacggctcgtcggcgaatcgccttggcgtatggtcctcgaagcggcgggcgcggcttggccgcacgcggcgctaggaggccttgtcttccgggcgcatggacagcaccggggccttggcggtcttgatgaccttttcggcgacggaaccgaacaggatcttgtcgatgcccttgcggccgtgggtgcccaacacaataaggtccgcgcccacttcctcggcggcgctgacgatttcctcggcggcgtagccggacacgacccggccttccacgggcacgcccttaaaaaactcctgcacaaaggaatccatggtctcggacgcgccgctgacgatgccggagacgaaatcgtcgatgtagctggcctggacgtggaactccacatactgggtcagcgacggggccacgtacagggccacgaccttggctcccagggcctcggccagggtcttggcgtaggcggcgaccttggggctgacttcggaaaaatccagggcgcacagaatggtcttgatggcaaccatggcggttcctcgcgtgtttggggtttggcttggggacaagctaccacggcgcgaaaaaatgtaaaaggccgcacgggctggaaaagtgcaggaaagagctccgacgtcggcgggcaggcggcaactggccggatgcggcgggcgcctgtagggggattttagcggctggccagcacccggcgctggcggatgcgctcaatgggatcggccacaagcttattgagcgccaggctcgccgctacggtgacgatcagggcgatgaccggcagatgggtccggccgcaggcgtattccacggccatgatgaccgtccagtgggtgatgtagatgggataggacagctcgcccacggcccggtccaggggcaggcgcttggtcagccggaagagcagggggacggacaggacggtggccgtgtagagatagaattccttgacgtaaaagccgggcaggaactgatagcccaggatggaggcgaggtagaggccaaagaccgtccacagggccggctggggaaagaccacgggtttgagcgcaacgtagagccggtaggacaggatgcccaggagaaaaaagccgcattccaccggaaaaaagcgctgtttccaaggatcaaacggcaggtcggccaggtagaccagggcgcgcaggccgaagctcagaccggccagggccagcagcgtgccggttccccggcgcacgagccagggagcaaaggcataaaagacgagttccagggacacggtccaggcctgggggatgagcaggaaaaaccaggccggggtcgggcggtagagggcgtcggcggaaaacgagagcgtgccggcgtcggtgatgtggctgaaaaagaggatgtcctggccgaagatggtgaggttggcggcggccaagagcgcggccacggccgggtcgagcttgtgcagccaggtctgccacggccccaggagcaaggcggtgtgcaggccgaacttgaagaccagcgacaccccaagcgagagcaggagcacggcccagtagagcggaaacaggcgcaggaagcggttggaatagaaaaggcgcgtctggcccggcccgttgtatttctcggtcaggatgagcgccatatagaagcccgagatgatgaaaaagaccttgatggccatgtaggcgtcggtcatgaccagaccgtaaagggggccggtgtggttgatgaccacggcggcggccaggagaaagcggaccagacccatgaaacggcgtcgcctctttgtattcgcgctgccggcggcaggctgacgttccaaaaaatggcccgcctctcaccgaagcgggccggtatcatagcaaactatcgcctatcgtcatctcccccggcggatcacctcaccccaattggggtttccaaaggggctcagcccctttggccgccggaggcattcttccttctcgtctctcaccgcagcaattgtctgtttttatgttggccttatcccttcagcgctttcgtcagcttggccttgtcgtcgctgaagagcttgtagttgatggcgtcttccatggcctggaagctggcttcgatgacgttgtgggacacgcccacggtcacccagcgtttggcggcgtcgccgcattcaaccaagacgcgcacgtgggaggccgtgccgcagccgccgggttcgcagtcgtcgcgcttaagccccgagagcacccggaccttgaagtcgagcagccgcatttcggccaggcgcgggtagaagccgcgcagggccttgcggatggccttgtccagggcgttgaccggccccatgccggcggcggcggtgtgcttgatgcgcccgcccaccttgatcatgaccgtggcttcggtgatgggttcggcccggtcatagacgttgtcgtcgagcacccggtagcgggtgacggtgaagtagctgcgcgcccggccaaggacgcgatttaaaagcagctcgtaggaggcttcggcggccgaatactcgtaacccatggcctcgcgttccttgatggtggacaaaagctccagcacgaaggggtcgttcttgtcgaggtcgaagccgaattcccgggccttgtagaggatgttggactggcccgacaggtcggacagcagcacccggcgcgcgttgcccacggtttccggggtgatgtgttcgtaggtacgcggatttttgaccacggccgagacgtggatgccgcccttgtgggcaaaggcggcgtcgccgacgtagggctggttggaaggcggggcctggttgaccatctcggagacgaagtgggccgtgggggtaatcagcggcagcttgccctcgggcaggcaggcgatcccgcacttcagcgtcagggacgggatgatggagcacaggttggcgttgccgcagcgttcgccgtagccgtttatcgtcccctggacctggcaggctcccaggaccacggcttcgatggaattggccacggccacgccggagtcgttgtgggcgtggacgccgaaggctaccccgggcagggccgtggtcacggcctcgaccatgcggcggaagtcgccgggcagggtgccgccgttggtgtcgcataagacgagcacgtcggctccggcctcgtgggcctttttgagaacggccaaggcgtagtccgggttggcggtgaagccgtcgaagaagtgctcggcgtcgaaaaagagttccttcacgtggggccgcaggaaggccagggagtcgccgaccagctccaggttacgcggcagggtggtgcccagggcctcggtgacgtggatgtcccaggatttgccgaagatggtgaccacgggcgcgccggattccaccagggccttcaaattggggtcggtggcggccgtgccacggtgggcgtgggtgctgccgaaggcggcgatggccgcgttcttgaagctgtagttctggatttcctggaaaaaccgcttgtcggtggggttcgatccgggccagccgccttcgatgtaggccacgccgagctcgtcgagcttgagcgcgatgcgcagcttgtcctcggtggtgaggctgatgtcctcggcctgggtgccgtcgcgaagggtcgtgtcgtagatggaaacgcgtcgcatggtgtcgctcgtgggtgtccgggcgcgctttggggcgcgcccgggcggtgcgtgccggccgggcgaacgcgggatgcgtttgggccggccctggtcgcgaaacgcaggattgtttcgcgggggaacctgccttgccgcgttttcggaagaggtgtcaggctcttcgcggaaaacgcggcaatgccggcgttccgtcctggtcagcgtcgtcggggctgaccgggcgggcgctagcaggccggggtgggagcctgggatagcccgaaggcgtcgtgcagggtccgaacggccagttcgaggtacttttcctcgatgaggcaggtaatcttaatttcggaggtggcgatcatgaggatgttgatgttctcctttttcaggatcgtgaacatcatggaggcgaccccggagtggctgcgcatgcccacgccaatgaccgagaccttgcagacgttggtgtcgtgctggatctcggccgcgccgatctcgggcttgagcttttcgagaatggccagggtcttgtcgaggttgccccgggagatggtgaaggtcatgtctgtgcggccttcgcgtccggtgttctggatgatcatgtcgaccaggatgccggcttcggcgatgggggcgaagatggcggcggcgacgcccgggcggtccatgacgttgcgcaccgtgatgcggcactggtccttgtcgtaggcgatgcccgaaaccaggacgtcttccatttccgtatcctccaaagtgaccagggtgccgggatcgtcggtgaacgtcgagcggacgcggaccggcacgttgaatttcttggcgaactccaccgaacggatttgcaggaccttggcccccatgctggagaattccagcatctcgtcataggagatgcggtcgagcttgcgggcgttgctgcacaggttggggtcggtggtgtagacgccgttgacgtcggtgtagatctcgcagacctcggcctccagggcggcggccagagccacgcccgtggtgtccgagccaccacggccgagcgtcgtcagacggcccaggcagtccacgccctggaagccggccaccaccagcacgtcgtaatcctccagcaggccgcgcagacgctgggtgtcgatgtccatgatgcgggcgcggcagaaattggaattggtggtgatgggaatctggaacccgagcagcgaccgggcgcgcagtccggcgtccttgcacaacatggcgaatagcgccacggacgcctgttcgccggtggtgaccagcacgtcgagttcggccggatcgggattgggggaaaattccttggccatgtcgaggagccggttggtctcgccggacatggccgagagggccacgacgaccttgaagccctcttgatgggccttctggatgcgggccaggaccaggcgcatgcgctccaggcccttgaccgacgtgccgccgtatttttgcaccataatccgcatggaagcctccgatgattcgggaaaagcgtccttgcccggcctgctagcggtcaagcaggttcggacaggccgcgatcaaggcggtcagggccgccgcgccccgccgcccgtgggcagtcaattcgcacagcctccccgaggggaccggcagccagtcgcattccaggcgatccggcggcgcaagcgcccgggacagatgctgcgcccattccacgaccgccacggcctggttttccaaagccgcttccaggtgctcctccacgcagggatcgccgccgggaatccggtagagatcgacgtggaacacctcgggccgggtcgggtagacattgacgatattgaaacttggactggccacctcggcctcgtcgccgccgggcaacgccccggccagtccccggacgagggtggttttgcctgatccgaggtcgccgcgcaagagcagggcggcccgggtggccgggttggccaggatttcggccaaaatacggccgagttccagtgtggccgcctcgtccggcagccgcaggcgcgctggttggctggggtccatgtcccgggctactttttgagcagcgtgcccaggatgtcgcgcatgccgatgatgccgacgatggcgtcgccggagacgaccggaatggtgtggtagcccttttcggtcatgagcgtggccacttcgtcgataagcgtttccggggtcacggtgaccggtttggcggtcatggcgtgaaacgcggtcagggccgacatcttttccacttcccggtccaggtccttcatggaacccaggggaatgaaaccgtcgagcagggagaacaccgagggcagggacagctttttttgctgggccaccagatcggcctggcagagaatgccggtcagtttgccggcggcgttgaccacgggcacgccgttgtagcccttttcaaaaagcagcgtggcggcggcggtgatgtccgtgtcttcgttgatggtgacgacgtttgcggtcatcacgtccttggctgtgagcatccgttactccgttgcggcccggggcagcatgtcggcgatttccgaggccaggttgccccgtgcgggataggcgtcggcgagggcttcgccggcgcgaccatgccaatacaccgcaaggcttgcggcgagcaagggggaaagacggcgcgccagcagactggccagcagtcccgagagcacgtcgcccgagccgcccacggccaaattcggggcgatgacggggctgacggccacatagccttcgggtgtggccaccaccgtggccggccccttgagcacggccacgcagccgtagcgcgcggccagttcccgggccgaggccatccggtcggcctccacgccggggatgtccgtgccgagcagccgggccgcctcgccgggatggggcgtcatgacggcgttattttctatttttgccgccagttcgcggtcgtcggccaagaaatgcagggcgtcggcgtccaagaccaaggggcagggcaggggcaaaagcgcggtcaaaaaaccggccgtgtcgggatggcggcccaggcccggccccagggcgagggccccggctccggcggcaaactcgcgcacggcctgggcctcggcagccgtgaaatggccgcacgtgcccatgggcatggtcatgacgtcgggaaaaccggccttgagcgcgatttccaccgcgccgggacaggccacgctgaccagccccgagccggcccgaagcgccccaaggccggccagaagcggcgcgccggtaagcccccggctgccgccgaccacaaccacccggccggcgctgcccttgtggagcagcggatcggccgggccgacaagccccatgacgcgcggggcgatgcgcccggcccggcaagggtgacgctccttgataagggtcgggatgccgatgtcgcgcaccagcagcttgccgacaaagggcgcggccggggcggcgaccagcccggtcttggccgcctcgaaggccaccgtggcatcggcccgcacagccacgggcgaaggccggccatgcaggccgtccaggcccgagggaatgtccagggcgaaaatgtacgaccgcccggccagccggttgacggcctcgaccacggccgccatgtccggccgcagctcgccgcgaaagcccgtgccaagcagcccgtccacgatgatgtcgggcgcgtcggccccggaaagatccgccttgaccagggcaatcatgggcaggccaagcttggccgccagccggacgttgtagccggctgcgcccttgtactgtccccgggggcgggccaaggccagggtcacgtccgcgccacggttatgcagatgccgggccagggccacggcgtcgccgccgttgttgcccggtccggccagcaagagcacccgcttgccggccaactcacccacctcgccaaccagggcgtgataggcctcgcggctggcgttttccatgagcgccaggaacgacatgccgcactcggccacgctggcctgatcccaaccggcgatttcctcaggggtcggcaagggatcaaagggactggcatcttgggacatgggcgtctcctgtgggcggagaagagtaaagagggaagacgaagaatgcctccggcggccgggagggggtaaccccctcccggaccctccctgtctggggcgggccttggggcttcaggcatagcctgaagtcccaaggcccgccccgaacaggaaggctgcggggagaccgcaggccatgtcgggggtccgggggcctgaggcccccggcggggcgcggggcggagccccgctcttcgttttctcttctcctcctatttcttggcgtcaaagcgcgccacgaggtcgtcctggacgcgcgacaggtaataggacagcggcaggctgaccacggtcagcaggcacatggcggcgaaggggtgcagatggccgcgtagcagatcggccccgtagcccaggatgggctggtggagcagatagaagctgtaggaggtggcggcggccagggccaccgccggcttggccccgatgcgggccatggccggccagacgaaaagcgttccggccagccccaggcaggcgacggtgaggagcatatgggcaagcagggccggcagggcgcttttgaagacaatggccaagggcagggcggcgtaggtggcggccaaaaagccgatgagccaggtcgtgggcacgccggtttccaggtcgccctggcgcggggcggcggcccgggccttccaggccatggcgaaggccatgcccagggcgaattccggcaggcggtagggcaggttgaagtagagcatgtaatcgaacagcgcggccgtgtcgctgaccttggccagaagcgacaggatcagccacaggccccagccggctccgacgcagacggcggcggccttggccgggctgtacttttcgaaaagcttcagcaaaagcgggaaggtcaggtagaactgggcgagcaggcccatccaccacagtgccggctccaggcagaaaaagcgggtggggtcgaaggtctggacgaaaaagagcttttcggccacgcaggccccgagcgcggccaggggcatggctccggcaagcagggccaccaggctccacagggccagggacaggtagtactgcggggtgatgcggccaaagcggcggcggaagaagtcgaagtaggccatgggcggcttgccgcccggattggcgtggggcaaggtgaggacgaagccggtgatggcgttgaagaccacgacgccgagatagccttggctcatgatgtcgccgaggatggggccgaagggattttgcgcgccgccgtcgggcagcacggtccagacgtggtagaagaagatggcgaacatggccagaacccggatgctttcgatctgggtgacgcggcgctgcatgagggcttcctttgctgtttggggtgcgacgggcgcgccggttgtgcggcgcgcggggcgttagcgtcccaggactttggcgaaaagcggcaaatattgcaaggttgcggaggttgtcggccatgcgggtggtttttgtgggcgtgggcgaggcgtttgacgaggggctggccaacacgagcctgtttgtggccggcctggccggcctggccggcgagacgcggcgcacggtcctgctcgactgcggcttcacggcaggggcggcgtttttcgcctgtccggccattgccccggccgaccgtcaggatgggccggacgcggtctggatttcccatttccacggcgaccatttcctgggcctgccctggttgatcgcccggctccacgagcaggggcgctcgcggccgctttgcgtccacggcggggccggggttgcggccaaggtgctggccgccctggatctggcctatccgaatctgcgggagaagctgtcattcgagattgtcgggatcgaggcccggccgggcgtggctttcgacctagccggttttggcgctcgggcggagttgaccgggcacggcgcgccgtgtctggggctgcggctcgaaacccggcttggggcgctgtattacggcggcgacgggccgatgacggccaaggggctggagctggcttcggggtgttccctggccgtgctggaagcgtacggcctggaagcgggcgtgcccggccacggctcggtgtccgaggctgtcgaagcggccgaagcggcctgggtcgaggcgttggccgtggtccatgtgcggcgcgaggtgcgccgggagcgcggcgacgccatccgccggatgctcaccgacgcctcgatccgggcgtttctgcccgagccgggggaggtcttcgaagcttcctagggcgtattcccggcgatacgccccaacagaagggcgtgctgctagttcgaggcgctgcccagggccgagtcgccgaccacgaggtagctgcctgggtgggagaccggggcgcggtcgcggcgcagcagccacatgtcgcgctccttgtccgtggccgcgatctgctcgtagtggcggtcgaggatggagcggctgtcgaggaaggcgttggccgccgccgacacccgcacgcagcccttggaatccgggccgccaaggcgcggttcgccctggtccgggtcggtggcgtgcattaagaggcgcatctggctgtcgtagacgccctggcggaactggcgcggggcctgctggtagccgaaatcccacacccggctgccgcgcgcgccaaggccgcgccagcccttgctgtttttgctgccctcggcccggtagccccagttttcgggcagatgctcgaaaacgcccaccggcgtgatgaatgagtcctcccggggccgcagcttgcccgaggagatgaaatccgcgccgacaaaggccacgcgtttggcctgcgcgtcgtagtaggccaaaagcagcagttgggtggccgggttgcggtcggcgtagacgaaatactggctggctgcgagatcggcgttggcggcctggagccgggccagggcgtcggcacgggcggcgtcgcggaaggcctggccggggtcagtgagcagttccagatggcgctggccggccttgccggaaaagcgggccatggtccgggccgtgaccgcactggcgaactgccggccgacttcaaggagttcctggcgcacggcggcatcggctacggcggcggcttcggcctcgtaaaagggcgtggccttggccggcgcagcggcggtgggcgtggcggccggcttgtccttggccgccagggccaggcccggcagccagacggttaaaaagacggccaaaagcccggccacggcccatcggccggccagggaaagggccgcctgacgaaaaagcgggcctcccgtccgagggaaacccgcttcgtgagcctttgggcaggacacgccgcgaacggcgctagaagacccgacggcctcccgcataatgcgttctccagtaatcttcttcgaggtgggagatggtgacgtttttgccttggctggcgctgtggatgaacttgccgtcttccagataaatgccgacgtgattgacgccccgtttggagcggaagaagacgagatcgcccttgcgcagattgtttttggccaccatggaacccacctggtactgctcccgggaggagcgggggaggtggatgccgtagcggttgaagacccaggtggtgaaaccggaacagtcgaatccggagttggggtcgcagccgccggaacggtagcgcgtgccgagctgggtatgggcggtgcgcaacatgcggtcgtagacaccgcctttgcgctgcaccgaggtcagctcgaaaaggttgtcgctgataagcttgtccggcgaggccgcggcctgcatccggggggccgatgcggcgctgggagccggcgtggagccgccctggtcgaacaggttgccggagatgaggttgttctcggcggcggcgatgagctgggcttcgtggtcgccagcgaccaggaatttgttgctggcgttaaagccctggtagtcttcgaaattgtaggagtaggttttaggtttcgaggtgcacccggccagggcgagggccaggaccgccatgacgacgtagggtttgagcttggttaggcctttggcgtgtgcgcgcgcgtcggtcaaaacgtttcctccttgctggagttgccggccggggccgcttccacgtttccgcataaacctttcggtttcgtggggccgctgatcgcctcgaagcgtggaccgtttgctcggtccaccaggacgatttttcgtttgcatcgccggatacagtttcgaaaggtagagtcccgtttaaaagcttcaaaaatccgcgtcaaggttattttgacaatttaataaattgaaatctccttcccggccctttccgggccttgtccgggaagcggaaatggggaacactcggcggaaatggcgaacattttttttcttgtcgggccgggcggacagcgggcggtgacggcccggcccggcgacaccttggctcgggcgcttttccgggccggctttttcgtgggcgtgcccctgtgcgccggtctaggacgttgcggccgctgccgggcgcgctttgcggccgatgcgccgccgcccttgccggccgaactgcgtcggctgtccccggacgagctggccgccggctggcgcttggcctgcctgcatccggcccggggcggcgaacgtctggaactgcccgagggcgcgaccactccggccgggcctcctgtcgcgccgacgcctgaagcggccggcgacggccccctgggcctggccgtggaccttggcaccaccggtctggcttggcggctggtgtccctggccgacggcacggtggcggcccaggggcgcggggtcaatccccagcttggggccggggccgaggtggtctcgcgcctggcttttgccctggaacccggcggcggcgactatctgcgccggctggttgtggatgaactcaagcggttggccgtccccgccggccccaggctcgccgccctgtgcgtggccggcaatgccgtcatgatgtcgattttgtgcgataagcccttgggcggtttggcccatgcgccctatggcctgtcgtggcgcggcgacagcctggaacgccttgatcccggcctgccgccggcctatgtgccgccgcttttcgggccttttgtcggcgccgacatcgccgccggtctgaccgccctggtgcggcaagcgccggcctacccttttttgctggctgatttgggcaccaacgccgagctggtgctggccctttccccggaccgctatctggccgccagcgccccgctggggccggccctggaaggcgtgggcctgtcccagggagccatggccgggccgggcgtggccgtggcctttgctctcaccccggccggcatcgtgccggaattttttgaccccgatcatactggagcgccgcgcggcatagccggaccgggctatctgtccctgaccgcgcgactggtcgagcagcaaatccttgacgtggacggtcgattcgctacaaccccggccgcgaccccgcttggccggcgtctggccgcccaggtcggacgcgcccacggcgaaccgtatttcgaaaccgccggctgccggctgccggccggcgacgtcgaggagttgctcaaggtcaaggcggcctgcaatctggccgtttcggcgcttctggctgccgccggcctggccacggccgatctggcctcggtccatctggccggggcgttcggcgcggccgtatcgccggccgatctcgaaaccctcggctttctgccgcccggactggccgggcgcgcccatgtggccggcaacctgtccctggccggcgcggcgctgtttctggccgacgccccaagccgccgtcaggcggccgggcttgccgcccgcaccacactcgttcccctggtcgacgccgccgattccggcgaggccttcatccaaaggatggttttttcctatgtcctctgacgccgccgccgtgccggctcgtcccggcgccaagcgcctgcttgcgcccctgcccccggacgtccgcgcccggctcgaagcctatcccgaattgctgcgaaaggccttgccgctgcgcccgggcctggtgcgcgaactgcccaaggtcgtgcgcgaactgtccctgtcgctgaccgccgagcgcgaaggcggcccccggccgggctacttgagcgacccgaaggtgctgtcggcctatctttggtattatctgccctggaaccttgtacgtctgtcgcgtctgctgcctggcctcgacctcgacattcccgacggcggggtggtctgcgacctcggcagcggccccttgaccttcatccaggccctgtggctgtcgcggcctgatctgcgcaagcggcggctgcgcatcacctgcgtggaccgctccaagcgggccctggaactggggctggcccttttcgccgagctggccggcttcgaccccacccgcccggacgcgccctggcgcatccgcgtcacccggggcgaatactggcagggattgaccgacggagccgatctcgtggccatggtcaacgtggccaacgagctggccggcaaggtccgcgaaccgctggacgagcgcatggagcgcgtggccgcccaactgtccgaaagcctcgtgcccggcggccgggtcctggtggtcgagcccggcacgcgcctgggctggcgctgcctgctggggatgcgccaggcctttgtcgagatggacatggatattgccgccccctgcccccaccgcgaggagtgcgtgctcttggccgggcgcacccgggcctggtgccatttcaccatgtcgccggtgggttcgccccgctggctgaccgctttttccgagcgggccggccttggcaaggagcgcctgagcctgtctttcctgctggcccgcaaggcccgccctgcgcccagtggcggggcgcgggtggtgtccggggccttttccctggccgacgtgccgggcagcgcggtttacggctgctcggcttccgggctgctggtgctgtgttccccggaccgccgtccgcccgccccgggcgacctgctggccgtggacgtgccggccggcgcgccgctcgacgccaaaagcggcgcgccgcgcgtcatgctcgccccggacccgtccggcgtggggtcggcggagccccgggccgcaaccggccgtgcccccgtccctggggacaaggcggcccgcggccaggagcgccgctccggttcgaccaaagccggggccggttcccgggaggaaaagggcggcaagcgacgtccccggccgggcggcgcgcccggagcgtcgggtccggccggcgcgcctggctcgtcgcgccagtcgccggggagcaagccgccccgtccggccgggaagggccaatcctcaggatcgggcaaaccgggccggccgcctcgttcgcgccgggactaaaggccgcgacggttgttgtccaaggccgcgaaatacgttacaagcgcccattcattccgcatggccgaagcattcggcaagcgtagcaaaggaggtcccgcgtggaggtgtcgccaaccggcatcccggggcttgtcgtgatcaaaccgaacgtgttcggcgatcaccggggtttttttctggagacctacagccgggaggcttacgccaaggccggcctcgattatgattttgtgcaggacaaccacgcccgctccggccccaagggcgtgctgcgcggcctgcatttccaactgccgccggctacccaggccaagctcgtctgggtgacccggggagcggtctacgacgtcgtggtcgatttgcgggtggggtcgcccacctataaaaagtggtacggcatcgagctttccgccgacaatttcctgcggttcatggtgccccggggctttgcccacggctatgtgaccctgaccgaggacgccgaattcatgtacaaggtcgatgctccttacgcgcccgacctggacgccggcatcgcctgggacgacccggacatcggcatcaattggccggtcaccgatcctgtcctgtcgcagaaggatgcggtccagccgcgtctggccgccctgggttccccgttcgtctacgaaccctaggaactccttgaaacccgagtggttacgagtgaacacgatttacgagcgccttgcgtcacttccgtaggcctgccgtttgatggcgtgacgcaacgcgaattggagaatccgcggctatgagcaattccgatgtcgggacatcctctggcggacgttatgccctgattttggccggcggctcgggcacgcgcctgtggcctctttcccggacgcttctgcccaagcagttgctggccctgggcggagaggcgaccctgctccagtccacggccgagcgcgtggccaaggcctttgccccgacgggcatcgccgtggtgaccaacgaggaacacgtttttgaagtgcgcgcccagttgcgcggccagctcccggacgtggacagcgccgtggtggccgaacccgtgggccgcaacaccctgccggccatactcctcggactggcccccatcgtggccgccgatccccaggccgttgtgggcgtgtttccagccgaccaccgcatcgacgacgtcgcctcctgggtgcgggccatggaccgggcggccgagctggcccgggacggctggtttgtcaccttcggcatcccgcccaaggccccggaaacgggctacggctacatccaccggggagaggccctgggcgagggcggctacgccgtgctgggattcaccgagaaaccggaccgggaaaccgccgaagcgcttctggctagcggcgagtattcctggaacagtggcatgttcgtgtttcgggccgacgtttttctggatgccgtggctgttcatgcgccggttcttcacgactggtggcaggcccggggcaaacgtcccctggccgacggctacgccggcattcccgacgtctccgtggactatggcgtggtggaaaagcttgaccgcatcgccatggtggaggcgggcttcgactgggacgacctggggagctgggaggcgctgtaccggcttggccggcgcgacgccagcggctgcgtgatccagggcgacgtgctggccctggactgctcgaactcgctctttttttcacaaggtggggctctggccgtggccggggtcaaggaccttatcgtcatccagaccaaggacgccaccctggtgtgcccggtgaccgaggcccagcgggtcaaggacgtggtgggggcgctcaagaaacagggcagcaagctcgtcgaggcccatgtgacggtgcgccggccctggggcagctacaccgtgctggaagaagggccgaattttaaaatcaagcgcatcgaggtgttgcccggcgcgcggctgtcgctgcagatgcaccaccaccgggccgagcactgggtggtagtttcgggcacggccttggtccaggtgggcgaacgggaaattttgcttacggacaaccagtccgtggacattcccaagaccagtctgcaccggctttccaaccccggaaaggtgccggtcgagatcattgaaatccagtcggggccgtatcttgaagaagacgacatcgtgcgcttcgacgacatctacggccgcgagggcaaaagccccaaatagagtcagcaacaggccggggattcgtgaattttttcattagaccttgacacggaagaagcaggctgggtaaaaagcgcggtgcgacaatccgcgccgaggtgaggggacaaatcctcggaggggttcgtgacgtggcgacacgtctttctttcatccgcctttccccgtgggggggaaggggccgttgggcgtctttgcgcccggcggacaaccagcaaaggcatgggcaggggacgtatggaggagaaaagatcgaattcggccggcggtgtgggcggcatggcgctttttgccctgatcggcttcgtcggcgccctggtggtggggtggggcatcttcccgaagatgctgtacagccaaaagacgcaacctattcgtttcagtcacacggtccatacccagctgggcattgagtgcgagcagtgccaccatctgggtcccgacggccgctttgccggcctgccttccaccgagtcctgcgccgagtgccatggcgaagagaccggcgatacctctgccaacggcaaggaaatcgacaagttcgtcaaggattacgtcaagaccggccggcaggtgccctggcttgtgtaccagtaccagcccgacaacgtgttcttctcccacgccgcccacaagggattcgagtgcaccaagtgccacctcgacgtggccaagacggacactcccccgccgtactacgagaaccgtctgagcggttacagcaaggacaccatgaagatgtgggaatgcgaacgctgccacgcttccatgggcaccagcaacgcctgcttcgtctgtcataaataaggggggagaaatgggacttgatcgcagagctttcctcggtcttgtggcgggtggtaccgttggcgccatgttcacccccattccgtggaaattgattgacgacgcttctatctggacccagaactggccgtggatcccccgggttcccaagggccaggtcgattacgtggccaccaccagcaagctgtgcccggctggggaaggcctcaagatcatgcgtgtggccggcaacccgattctggccggcggcaacccttcgcatccgttgtcctgcggcggcgtctccgccctggcccggtccgaagtctacatgctctacagcccggcccggatcaaatcgcccatgaagcgcaacggcaagacctttgcccccatcacctgggagcaggcccttgtcgagatggccgagaagctcggtgcggccaagggcgcggtggcctccatctccggcgacaacaccggcaccatcaatgaagtcctgaccgccctgacggccaagctcggcagcgccggcagcttcatgatgccctccgaagccaccaccgccgccaaggccatgaagctcatgggagcccagggacaggccggctacgacttcgaaaacgccgataccgtcctggtccttggcgcggacatcttcgagacctggggcacttcctccaggaaccgcaaggccttcggggccaaccgcccggccggggccaagcccgccaacacctacgtttacgtcggccccagccgcaacaacaccgccgccgtgtgcgaccagtgggttccggctgccgccgccgatctcggcgtggtggcgctgggcatcgcctggcacctgctcaaggccggcgcgaccagcaacgctccagggttcgacaccttcaaggccgtggtcaacggcggcttcggtcccgaagacgtcaagcgggccacgggcgtggctcccgagaccctggccgccatcgccaaggccctggcttcggccaaggcccccctggtggtcaccggctcgcccttcggacagggcctgggcgcggccccggtcatcgccggcatgtccctcaacatgctcctgggccgcatcaacaagcccggtggcgtttacatgctgccggaactgccctcggtggtcccgggcgcgctgacccgcgcggccatgctcgacggtgatctgcccgcgtttctcaagggcgtggagtccggcaaaaccccggctcccaaggccctgctcatctatgacgccaacccggcctacggcctgcccgaagcggcgaccatggccaaggccctggaaaagatcccgtttaaggtaagcttctcctccttcatggacgagaccgccgccctgtgcgacttggtgctgcccaactcgctgcccttggagcgctacgacgacgtggccacgccctacggctccggcttttgcgtctacagcctggtgcggcccatccagaagcccatctgcgacaccaagaccaccggcgacgtgctgcttggcctggctcgcaagctctccattgacctcaagttcgacaacttccagcaggtcatcaaggaaaaagtcgccagcctagccaaggtcagcggcggtttcgtggccaaggacgtcatgccctggcaggtcgcggccggaaagcccgcgcccgccctggtcggcggcgacctctggaaggccctggaagccgggtacgcctggaccatggtcggccaggcggcccagaccgccatgggctttgccgccgaagtggtggccaaggccgtcaaggccggcaagcccgccacagccacggtgctggctccctacgcccagttgcgcaccggcaccccggtcaccggcatgccctgccaggatctgaccacggtcccggacaccgagcttctcggcgacaccaccttcatccgcgtcaacagcgagacggccaaaaccctgggcctcaaaaaaggccagatggtcaaactgtccggcgccggcgtcgactgccaggccaaggtccacatcttcgaaagcgtcatgcccggcatggtctccgcccccctgggcttcggccataccgccttcgactactacagccagggcaagggagccaactacctctcgcttgccgccgtggtcgaagagccgggctcgggcctgtccatgtggatcgcccctgaagtcaaaatcgcctaacgaagggaaagggaagccgtcatgtccggacagaaaaaggaattcccgatcacctggggcatggtgatcgatattgacaaatgcaccggctgcggagcctgcatggcctcctgccagaccgaaaacaacgtcgaaccccagcgcgaggcttccaacaagctgcgcgccacgtcgtggatgctcgtctatgagctcaccaacgacaaagccttcccgaatcacgacattgcctatctgccccggccctgccagcagtgcggcaatccgccctgtgtgtccgtgtgcccggtcatcgccacggacaagaacgaggacggcggcatcgtgagccaggtctacccccgttgcatcggatgccggtactgcgtggccgcctgcccctaccacgtccgttacttcggttggtacgaccccatttggccggaaggcatggagaagaccctgtctcccatgacctcggtgcgccctcgcggcgtggtcgagaaatgcaccttctgccatcatcgctggacccaggccaaggacgccgcccgcgtcgccggcaaggatcccgataacctcgatgacggggcctacgtcacctcttgcgtccagaattgcccttccggggccctcgctttcggggacatcaaaaaccccaagcacaaggtgcacgagctggtcaaaagcccctacgccttccgtctgttggagcgcctgggcaccgatacccaggtctactacatcagccggcgggaatgggtccgcaagctcggcgacaactaccttaaaagcgagtaatcgggggggatgcaatgagctttattgaaatcgaaaaaacctggtaccccgagggcgtcgagcgttgctcccttgggaagttcatgaagtggctgagcgtgttgggcgtcgtcgccctctacggcttcttcgccatgatcgtgtgcttcgcctacggccttggcgtcaccggcctggacaactacttcggtttcggcctgtggatcaccttcgacctggccgtcatcgccctgggcgccggagccttttttaccggactcctgcgctacatcatccgtatcgacgaactcaaaaacatcatcaacctgaccgtcatcaagggctttatctgctactccggggccatgctcatcctgtccctggacgtcggccagcccatccggtcgtggttcggctactggcaccccaacgtccactcgatgctgacggaagtcatcttctgcatcacctgctacctgatggtgctcatcatcgagtacattccgcttatccttgagcagaagcagatcaacaagatcccgttcctgcacaacctggcccaccagatgcacgtggtcatgccgcttttcgccggcatcggcgcgttcctctcgaccttccaccaggggtcgctcggcggcatgtacggcgtcatgttcgcccgcccgtacgctttccgcgacgggtttttcatctggccctggacgttcttcctgttcgtcctgtcggccatcgcctccggcccgtgcatgacggtgctgatctgcggcttcatggaaaagatcaccggccgcaagctcaccacctaccgggtcaagtcgctcatgtgcaagatcggcggcaccatgctgcttatctacacggtgttcaagtacctggacacctgggcctggatcaacgacatcctgccccgggccggcctgacctttgaccagatgttctacggcatggtctacggcaagtggctgttcttctccgaactggtgctgtgcctgatcgtcccggtcatctgcctgctcacgcccctgcgcaagaagccgttcttcatgtacacgggcgccatcctggcctgcgccggcgtggtcatcaaccgctacgtcttcaccgtccaggccctggcccagccggtgctgccgttcaccaagtgggagatctacacgcccaactgggcggaatgggccacctcgctcatggtcatcgcctacggcttcatcatcatgagcctgtcctaccgctatctgccgattttcccccaggaagtcgggctcaacaagaagtaggaccgcgtttcccccgaaacgtccaagcccggccgcgcaagcggccgggctttttttcgactggtcgggcttggtcatggcgcgatgtcagctttgacgcatcgcatggatctggttgcgctggtccccgcgacgcggtaaccgtcgcgccgcatccaataacgctccatgcgcttgttttgcctgcacgacacggacaagccccggcgcgctgcccatgaaggcgcgcgccggggcttgttatcgatggcctgaacgacgcctaaccgaccgcggtgatgcgccgcaccacccaggttttgacgatctgggccaggcacatgtaggcgaagatgaccagggcgataaacccccaataatgggccggcggcacgaccaggccgaaggaggcggccaggggcgagaagggcagccacacccccaaggcgcagatggccagcgtcgtaagccccagcggcaagctggagcggctttgcaggaagggaatgcggtccgtgcggatgacgtggacaatgagcgtctgggacagcagcgattcgatgaaccagccggtctggaacagcgcggcgttgtcccaggcatggaaaacatgcagtaaaatgaagaacgtgacgtagtcaaagatggaacttaccgggccaagccagacgatgtagcgccggatgtcgtcgatgcgccagcgccggggggccttgacgatgtcgtcgtccacgttgtccgtgggaatggccgtctgggagaagtcgtacatgaggttgttgaccaggatctggatgggcagcatgggcaggaagggcaaaaaggcgctggccccgagcacgctgaacatgttgccgaagttggaactggcccccatgcggatgtatttggtgatgttgaagaaaatcttgcggccttcgaccacgccgtgctccagcacgtgcaggcttttttccagcaaaatgatgtcggccgactccttggccacgtccacggccgaatccaccgagatgccgacgttggcggcccgcagggccggggcgtcgttgatgccgtcgcccatgaacccgaccacatggccccgggcgcgaagcgcggccacgatggcttccttttgcatgggatcgagcttggcgaacacgtggcagctctccacggcctcggacagctcggccggacgcatggccgccaccatgtcgccggtgatgatgtggtccccggcgtcaaaacgcacttcgcggcagatcttggccgtgatgacggcattgtcgccggtaacgatcttgggctggatgccatgggccagcatggtggccagggcgtcggcggcggtgtccttgggtggatcgaggaaggccagatagcccatgagggtcaagtcggactcgtcggccacggcgaagtcgtggcgcgaaccgtcgacttccttataagccagggccaccacccggaaaccgtcgtcgttgagttcgtggaccaactcctgcatggtttcgcggtggtcggcgtccaggagcgaggtcacgccgtcgtggaggcagtcatggcttttggagaagacttcctcggccgcgcccttgcagataagcaccgccttgccggtctgcttgtcgcgcacgatgacgcttaaccggcggcgcatgaagtcgaaggggatctcgtcaagcagctcgtaacggttgggatcgatggccgaggcggcgtcgtcgcccgaggtgatgacggccaggtccagggcgtttcgcaggcccgtttgcagcttgctgttgacgtaggcgtattccagcaccgagcaatcctcgcggccggtgacgtcgaggtatttttccaggatgatcctgtcctgggtcagcgtgccggtcttgtccgtgcacagcacgtcgatggccccgaaattctggatggcgtccaggcgcttgacgatgaccttgtgcttggacatggccagcgcccccttggacaggcacaccgtcaccaccatgggcagcatttccggggtcaggcccacggccacggccagggcgaacatgaacgcgcccatccagtcgccgctggttgcgccgttgatgagaaagacaaagggcaccatgaccagcatgaagcgcagcatgagcatggtgaaatttttaatacccttgtcgaaatccgtctccacccgcttttccgaaagcttggccgcgatgccgccgaaataggtgcgcgctccggtggccactaccagggcggcggccgagcccgagaccacgttggctcccatgaagcacatggccggatcgttcagtcccgtctccccctcgggggcggcctcgccgaaggggcgggcggttttctccacgggcaaggcctcgccggtcagcatggcctggttgacgtggagatccttggcccgcacgagctggacgtcggccgggaccatgtcgccggcggagagcagcaccatgtcgcccgggaccacctgggccatgggaatttccgtctgctgcccgtcgcgcaggaccgtggccgtggtgtggaccatcttgcgcagttcctcggcggcggtgtcggccttggcctcctggatgaccttgagggtcacgcccaggacggccataccgatgatgaccacggccgagcggacgtcgttggtggcgtaggagatggagccgagcacaaacagcaggagcaccagcgggtttttgaccgcgtcaaacaggcggcttagcagggtgatccgcttggcggcggcggcctggttggggccgtacttggccagacgctcccgggcttcggcggcggaaagccccatggcggcgggcttggcgaccgggacgggttcggtgaggcgctcgccggcctcggccacgtcccgccacaaggcgttcaggtgctggaaggcctcgtagggttcgactttttgtttggcggccagggccgcgaagacattggctttctgtacgaagtgttccagggttttgacaaaggccgcttccggggccaggcgcaggccttcggggccgagggcggccgggtgggggggagcctggggtgtcgcttgctgcgggggttgcgtcatgacgcctccttcgattcgatgcgcgggggaggccggtccaagcaccggcaaggactcccccgatgccgcatcaggccctacaagccggggatggctttctcatgactgaagcaagacggacaatcaccttactaaattggcattttgccggctgtgcgccggtttggcgtcctgtgtccgcctactcttgggccacaaccttgggccatggccgttaccggcgcaccgcagccagaaaatccaggctggcctgggccgcctggtggaagtccacgccgccgtcgatttccagcaccggcaggtcgcccaacagttccagataggccttctggctagccatggacggctcggaggggtcctcgaattcgtagaaaagccccacgtccttcatgaaggccggcatgaggtcgcgccggtcggccaggcgcacccgggcggcggtcatgggcgaggcgtcgcgcttccaacgcaggatgaccagcccggccatggggcaggccagcttgaaccggcccgggccgaagcactcgtcgataaaggcgtcgtacttgtgctccaggtcccacagctcggcggcgggcagggccgagaaccgggcccggtcgacggcgtccatgaccggagccaggctggggttgttgagcaccgtgccggggttgacccggggcatcttggccacgccgtgcatgaccaggccgtcgccctcgcgggaaaccatgacccggtcgttgctgatgaactccgtgccgcagcgcatgatctccagggccagggtcgatttgccggccccggaaaaaccggcgatgaccaggccttggccgccttgggcgacgccggcggcgtggaacagcagcgccccgcgctttaagcgccattcgatgaagcggttgttgatgaagttgacgatctggttgtcgttgtccaggcacggccccacggcgtagttcttgccctggccgaagagaaagacgaggccggtgaggagctttttgaccacccggccgtcggcaaggtcgatggaggcttccttgagcttggtcttgcccggttctcgggggtggacggcaaaggggagatcgaagtccggcggcccggcctcgatggccgtgacctcgatgacggtcgtgccgccgctgccgaggaaatcgcggaagtagcggccgagcttttccgacagggcctgggagttggtggccacggccacggtcacgtcgtcaaaggtgacttccagacggtgggccaggggcgcggtttccaggacgggggccataagcccggcgatggtcggggcgctcatgcgatctcccccaggacatagtcggcgtaggtgccggccgcgtccaggccgcaagcgtcgaggagtccccggaagccgccgaaggccgagacttcgtagatggccgcgccggatggggtttccaccacatccacgcaggtgaaggccatacccgggaacaggttctgggccttgcgggccagttcgatgatctcgtccgacgggttgtggggcacgtagcggccgccggtgcgggtggtggtgtcccaggagttgccgctgccctggcgggcgtaggtggccagatattggccgcccaaaaacgacacgccgagatcgagatgcccgccggcgtgggagaccatctgctggatgtacatgacccggttgccggcggcctggtagtcggcgatctcctcgtgcatgtccgggccttcctcgatgacggtcatgccccgggccttggagctgtacagcggcttgaacacggcccggccgtagtccgagacggcggcggcggcttcgctgacgtcctcggtgacggtggtcggcggcatggggatgccgccccggcgcagcacggccgtgccgcttaggcggtcaatgagccgaaacatgctgtccgggttggaaaacaccggcagcccgccggaatggagaaaacgcaggatctccatgcggtccagggcgtcgggggtataggacggggcgattttcttgacgatgataccgtcaagttccgtcaggtcgttgtccttgtaaaaggccttgcccgtttccagatccaggcgcacctcggccatgtcgatgcacaggcgatagccggtgcgggcttccagggcgtccagcaaacgcagggtggaccagccgccggggatgcccaccacgccaatctttttcatgtttttctccatggttgcaggcaggttgtctagtagcacaaagcgtcgatgggcagcttgaagtcggccgggtcgccggcatgggcggccacgtgctgcagcaaaaagacgcctcggttaaacatgagccgggcgaaacgttcgctcagttcgaatcgggtcgaggtcataagcgaccggccaaggcccagggccagccggatgtcgaaggtcgtatccccatgcttggcggcaaaagcggcggcgaagcggcgcatctccaggatgacggcggaaaggacgcttcgccgggccttgtcgaagatgggcaggcggaagttggagaccatgtagaccgagacgtcctgcaccaggtcggcgtcggccgagcggtgcaggtcgatgtagtggatgcggttctcggccggatcgtagaggatgttgttggtgttgtagtcgccgtggatcagcacggtgtagggcgcggcaagggtgcgctccacggcctcggcggcgtcgacaatttcgtccagggacggcaggggataggagccgatggccttgggcttgacccgaaagcccgggtgcacggcgagcacctcgggcaggcgggcgcgcagttgcttgctgtagccggtgggctgggggccgggggtcagggtcttttcccagagttccccggcggcggcgcactgggcggccacggcccgggagagcagcttgaggtcgccggaaagggacaggtcctggatggtctggccgggcaagagctcaatgagcatggaactggtcttttccccttcgcgaaaggcctccaggtgcggggccagacccggcatcagggactcccagcgggcgaagttggcggcttcctggcgcagcttgccggtgtcgccgtccttgaagatgacttccttgtggcagtcgccttcgccgccgcgttcctgaatccggccgatgcggcagcccgagcgggtgccccagatggaggcgaattccacgtcggacagcgggttttcgtggccggcggcggtcaggatgtcgtttaaggcggtgaactggcggattttgaatttgtcgccggtgatggcgaagatggctgcctcgccgatgttgagcagggcgtcgcccatgcgttcgaggtagcggaagataaacagggtggtgagcagatcgccggtgttgaagcccgtgcgcagttcgtcgcggatgcggtcgaactcctgcttgtagagccggtcgagatgcagctcgcaacggcagattttgagcgccgcggacatgtcgcgctccagcaccgccttgggcatccagcccagggcattttggatttcctggaaaaacggcttgtaggcgtagcgcagcaagcaccccgggtcgtcgtagtggcgcgtttggcgtaccacgttgacggcatggtcgcccacccgttcgaggttgctgccgatgatgtgaaatgcccggatgcgggccacttccggggcggtgggccgggtttcgccgtgcagggtggcgaaacaggcgttttcgatgacgcttttcaagttgtcgatatagtcgtcgcgggcctcgatcttggcgatggccttttcgtcacggtgcttgaggacttcgatggtcccggcgatctgtcgctcgatctccacgagcaggaatttgaaattgcgctcgatctcaagcatcgtcttcgtcccgggcggtgattaaaagcggcgcggaacattcctgttcgcgctccttccagcggaaggtcaacttgagtttgcggtcctcgcccttggccttgccttccacggtgacggccaccagccccttggggataaggcgcagcacgtcctcgccctgggacagggtgatctcgccggaggcgaaaccgtcgcgcacggcctccagataggcggcgatgacgtcgggctgctgcaatccgtcgtatttgaaaagcttgttcacgcacttcctccttggcggcccggggagacgatccgggcgcgtccctggctgtagcacccgattatgaagaaaaggtgaagcccggcttgtttttttgcacagcggccgggttttcccacgccgcgcgttcgtcatgggagactcacgcaaccttcatcggtttggcctgtacgcggccggcccgattgggctagtgtcgcgtccgcgacaagcgcctctggcgtttcccgggcaacgatgaaaaccaccattttttcttaaaaaatacgcccgtattttttaagggaagcgacaaaaggggcaggcacggaggaggccatgagtcaggaagccatcgatcaatttctggcctggttgcaggccgacaaggaccggctgctgctggtcggcggcctgccgctctccgagttggtggcccacgccgccgcccacgggtttattttcaccgtggaggaactcaaggccaggcaggccctggtgcatctgttggaaggcacctagcgtcgcgcccccctctccgaaataaatatgttggtattttgggggagtgcaatggtttttcgcttgttgccggcaaaacgctcgctgcttttttcaaggatacgccacgcggaggggcggtttggtcgccgctcgcgcccgctttcccccacccgcaccggagtacggcatgttgcagtcccttgccagccttgacggccataccctgatcctgttgtgcctgtccctgggcatcgccctggcctttgaattcgtcaacggctttcacgacacggccaacgccgtggccacggtgatctacaccaaggcgctacgggccaccacggccgtcgtcctgtcgggcatctgcaattttctcggtgtgctgcttggcggcatcgccgtggcctattccatcgtccatctgctgccggtggacctgctcgtgtcggtcaactccaaccttgggttggccatggtcttttccctgctcgtctcggccatcctgtggaacttcggcacctggtacctggggctgccggcgtcgagctcgcacacgctcatcggcgcgatcctgggcgtgggcttggccaacgccgtgcgcgaagggctgccggccggggccggggtcaactggcacaaggccatcgaagttggcttgtcgctttttatctcgcccatcatcggctttgtcctggccggtgggctgctgcttttgctgcaacgactcctcaaaaatccggccctgcaccggccgccccagggcgacgcgccgccgccgccggccatgcgggcggcgctgatcctctcgggcttgggcgtgagcctggcccatggctccaacgacggccagaagggggtgggccttatcatgctcatcctcatcggcatcctgcccggggtctattccctggacgccgacctgtcgcccggggagacggccatggtgcgccaggcggcggcccggttcaccgattatttcgacgcccaccggctggagatcgacaaggcctacgccagcggcgcgatccgggagctgcccgaaaaagcctcggccgtgaactgcgacgtgcgcggggccgtggccgcctcggaagatatccagcgccagctagccctgtatgattccattgccgccatcccggccggggaacgctgggagctgcgcaccgacatcctgtgtctggacgacgccgcccggatcatgcaggggctttcgggcagcgccgccgagcgggccgagatcgagcaactgcgcgaaaccttgcgccggccaacggaatacgccccaagctgggtcatcatggccgtgtccctggcccttggcgtgggcaccatggtcggctggaagcgcattgtggtcaccatcggcgagaagatcggcaagaccaagctcagctacgcccagggcgcttctgcccagatcgtggccatggccaccatcggcctggccgacggcctggggctgccggtgtccaccacccacgtgctgtcttccggcgtggccgggaccatggccgcccacaaaagcggcctgcagatgcgcaccctgcgctccatcgccatggcctgggtgttcaccctgccggcggccatgctgctgggggccgggttctttttcctcttcacggcctggctgtagggccgacgctgtccggcttcgtccgctttctgcggttccttcaggccgcttgacggtatgcccgggccggccgggcttgcccgaactccggtttgcgcctagataagcgcctggccggcgcaattgcgccgccaccggacgttctcctatgctgctgtatatccatgtgcccttttgccggagcaagtgccggtactgcgcctttgtctcgcgtcccctggacatggccgaggtggaggtctacgccacggccttgccgctggagatccggcatttcggcaagaagctcggccggcccaaggtcgagaccatttatttcggcggcggcacgcccacgctgttgccgccctgggcgctgtcgcgcatcctgccggaaattacccgccatttcgacgtgcatccggccgtggaatggacgtttgagggcaatcccgattcggctctggaccagcagtacctgagcatcctggtcggggccggggtcaaccgcctgagccttggtgtgcagagcttttccgacgccatgctcaagaccctgggccggccccatgacgccaggacggcccagctggccttcgaggcggcccgcaaggcggggttcgccaacatcagcctggacctcatctggggcttgcccggccagcgcgaggccagctggatggaggacctcaaggcggccgtgcgtctgcggccggaacatctgtcctgttacggcctgaccctggagccgggcacgcccctggccgcctcggccgaggccggcgagctggagctgccgccggatggcgaacagggccgcatgtacgtgcatggggcggagtttctggaagagcagggctacctgcaatacgaaatctcgaattacgcccgcatgggtttccaaagccgccacaattcgggctactgggaaggccgggactatctggggctggggccgggggcggtgtccaccgtggccggggtgcgccatgaaaatccccgcgacgtgcgcgactgggctgtccaggccaaggtcgggcgctgcggcgtcggcggggtggcgctctcgcgtgaggagcgcatccgcgaactggtcatgctctcgctgcgaacggccaaggggcttcggctggggctttacaagcggttgaccggaattgattttcttaaggaaaacgaagcgctcgtcaccgccttgcggcaaaaggagctggtgcgtctgagcgccgggcatctgcggctgaccaagaacggctttctagtcagcaacctcatcctggagcgcctgcggttctaacggttgccaccgcgtcggtcttcttcgccttacccccaaggaatttcttctcgccactcccgcccaccgcaacagcaacgctcctcctttaaaacccattcggggggtctgggggtctcaggcccccagccgccggaggcatcttcctgtatttccaggctttcactctcctctacatgccaccattagccgccggcaaggcgtcggccagggcggcggggggcttgtggccgtcgaggacggcggcgtaggtcagggcgtcttcgcggaattcggccagccgggcgcggggcaggggcgtggcttcggcggtgtcgttatccagggcgttgaccggccggccgtcggcgtacatgcggaaatcgaggtgggggccggtggcgtagccggtggccccgacgtagccgatgacctggccttggaccacgcggctgccctgggcgatgcccttggcgaagcggcttaagtggttgtagcgggtgacgtaggttttgccgtggcgcacggtcaggtagttgccggcggcgtggttgcggccgcgttcgatgaccacgccgtcgcccacggtccagatgggggtgccggtgggggcggcgtagtccacgccgtagtgggctttgcggaccttgaggatggggtgcaggcgcgaggcggtgaagcccgaggtgacgcgcagaaatgacaggggggcgcgcaggaaggtcttgcgcagggggacgccttcggcgtcgtagtattccaggcggcccttgtcgccgaggatgccgtagccttccaggaccttgtcgccgctggtgtagcgggcggccagcacgcggcccaggccggccgggcggccttccacgtagcgctcttccaccacggcccgtacggtgtcgccgggctggacatcgcggctgaagtccatgtccgaggcgaagatgtcggccagggccagggcggtggccaaattgccgccgctggcggccacggcttcggacagggtggatgtgacggtggcggtcaaaagggcggggcgtacctcgcactgtttggtttcgacccgggcggcaagctcgccgtcgttttcgtcgatgaccagggtttcagtttcgttgatgtcgtattcaaaagagaccagttcccggtcgcgcagggtgaggcggtagggctggccggtgcgcaggttggagaaggagaagtcctcggggtcggccagggcggcgattttggccggctcggcatggcggccgaggaggccggccagggtctggccggggcggatctcgccggtgatggtccgggcgtcggggtgggccgcgtttggcgcttccggttcggggggcgcggcgtttacggccggctcggtttcgggcggactttcaaacaggttgccgacgacggcgacgttggtttcggaccgggccggggccggggccggggccgaggcggtctggaacagcgactccaggaaggctctcggcgcggtcaggcgggcgaggcccaggacagcggccagagccaggacggcaagaccgaggagggtgagcagtcgccaggagcggcgacggtgcttggaaaagatcggtcggccgggatcaccaagtggcgggtagggcatgggtgtggttccatggggtcgcgccgggcaggcggatggcgttaggctgaggctgtgcggtcatggcgcttcggcgtcggcgcgcggatgacaggagtatgaaagaatgttcatgtttcgttgtgggattgtatggatagcgtctggtgcaatcgagtcgtgcggagaatagcgatttttctggatcggtcaaggtggggtgttttctgcaaagagtgactggtgtttggttgtttttggatatgatacgtccttgatttctttgtttatggagtaaatttcatgaataaaacttttgtttttaatgtactatattttttgaagagaaaatcgtccctttgtttagactattgcgtggcgatgtattttgcaagagtctgggtaagggactgcaacgcgcgtcggccgcactgcggttatgtgccctggcggcgcagggccgggggggcggcagacggagcgcccggccctggcaggcccggcaaaggggacgcccggggccggccccgagagagggcttggggcgcggccgcccttgggctgctggccgccttgctgttttttgggggctgttccggggccggggagccgactgggccggccgggccgccggggcgactgttcggactggcctttggcgatgcgcccggtccggggcttacacggttggccgtgccgctgccgagtgccctggccgagtccttggctttctatgccgcgccggggcagggggacgcgccgtttggcgcggccctgacccaggccacgttggccttctggcaaggcggttttttctccgtggaagctgccttggccgcgccggctgatgcgccggcgctcaccgcgcaactgactcgcgaccttgggccaccgcattgccgcgaggccgcctccgggcgcgtgtgcctgtggcgggccggcgatttcgaggccgtgctggagcagtccggcgacgcggcccggctcatgttgcgccgggccgccacggcggcggcggtggcggcggccctgcctcagccgccgcccctggagcgcgccgagtaacgccccgcgtaaacacaaggccccgccgccggagaaacagtgtttcccgaccgacaacagcgccgatgcacgccacacccacttaacccctttctccatctgggggatctgggggcctcaggcccccagccgccggaggcctcttatctccttatttttccttcataaatatctcacgcgcggccacggcggtgtcggggaaatcggcaaacacgccgtcaacgccgagttcgtagaactggagatattccttgatggggtcgttgccgtagtccttggccaggtagcggtcttcgttgcggaaagtgtagggatgcacggtgagcccggcggcgtgggcgtcggccaccacggtattgggcgcagccagggtcttgtccgggttttccttgataataagccgcttccagggaccgatgccgttggcgaaggcggcgatctcctggagattggccggtgagagcagttcggcgaaggtgcgtttgtcgccggagaccacgaaatcatagggacgcatgtcgggctcgtcgtagagaaagaccagcttgaccggcgtcatttggcgcaagtccttgaggttgccgatctcgaaggactggatgaagaccggggactcggccttgtcgtagccgtttttggcgagaatctccacgagcttgccttccaggggcagaccgatgcttcggaaataggtcggatgcttggtttcgggatagatgccgatgacgcggccggtttccttttctttgcgtttgaccagttcgatgacctcttcgaaagtcgacacggcgaactggccgtcgcggctgtggtcgcggaagtcgagacgttccttggcccgtagggtcctcagttcggccagggtgaagtcttcggtgaaatagccatcgatctcggttccatcgatggttttcttggttttgcggtccgggaacttggcggccacgtcggtggtgccgctgatgtcgttttcgtggcgggcgatgagcacgccgtctttggtggcgacgaggtccggctcgacgtaatcggcccccatgtcgatagccaattcgtaggaggccagggtgtgttcggggcgatggccgcaggcgccccggtggccgatgaccaggggggcggggcgggactgggccagggcctcgccggccagaccgctggcggcggccagggccagggccagggcggcgagtcgaagggtcgttttacgcatgggatgctcctcggatgtggtatggaaaaggccaaggtgcgcccggtccgtgtcctccggataaccgacaggtaaccgatgcgcgacaattgcgcgagtctggcgtcgcggtcatttgacagccgccctcgccggtcctacaaggcccaaatgcaggcttccaccgctttcgctccgacctcagggccggccggtcccctggaactggcggccaggcttattcccaatccctccgtcctctccgaccggggattggctgtcctggtcgagacggcctaccgggccagcctcaagcgggaagaggggcgctatccgtcgtttcaactgttttcgcctctggccggcggggccgagccggtgctcgacctgcggttttctccgccccaaccctgtacgctgccgaccttacaccggctctcgccgggcatcccgcccggcccctatgcgtttgtggccaaggaagggccggaggggttgcggctggaaggcgtgtccaaggtcgagtactccggctttgccgccctgcgcggccgtatcgactaccatggcggcacccagttcccgggcctttcgttaagcgtctcggccccgggaaagctgcgggcgtcgctggtctgcccggatcagccggcgctctatctggagttgcgggaaggccggctatcggtttgtcacgacaacgctttttcgcccattttcctgccgctttgccgtcaggccgcacaggccttgacccacggggccgaggattccggtgccttgcctagcctggtcaaggcgaccctggcccgggtgttcgccctggccgtggccgccggccatggcggcatgttcgtgtttctgccgcccgggcgggccgaggccgccgccgccaggacgctcctgtcgcccggggtcggcgtggcctggcccaacctcggccgggtggcgcagaatttggccggcgcgggtggcggtcaggccgtgcatctggagcaatgggacacggctacccgggtgacggcccaggcctcgtgcgtggacggggcggtgatcctggacgccgccttgtcggtgcaggccttccgggtggagctcctcgcccgcgacgaggacgccttaccgctttgtctgtcgctgtcgccccagtccacggagctggtccctacggcttccctggacatcgccggcttcggcacccgccaccgcagcgccgcccgctatgtggctagggcgtctggagccgtggcggtggtggtatcccaggacggcgagatgcgggaattcgtccggctgcccgatggccgagtgggcgtttgcgggccgctggctcccatgtccgtatcggctccggcggcctgatgcccgcattggcgctttctaaaacgctgcgaaccggctatgcttgccttcggcgagccaacgtcaaagtggatgccggccgcgccgcgcgggcaagaagtgagggaaaggcatgggagacaacaagagacgccgcagccgggtctgcgcccagttcgacgcgtatgtgtacatcgacggggagaagattccggtcagcacccagaatctgagcctcaagggggcgcttttctgccccgagccgcgcttggccccagggcgggactgcacggtggtttttgaactggccaaggacatcaaggtgcggctcaaggccacggtcgtgcgctccaatgacgaaggcgtcgccattgatttcgacagcatggacgagtccgcctttttccatctgcgcaatatggtgcgctattcctcccaggacgccgaccgcattgacgacgaactgcaagtgccggcctttgacgtggaccgcgaagggggcgggtcttgaagatttcgcgactgctggccgcctgcgtgctgagcctgccggcctgccttggcagcccggccctggccggcggcctggatcaggccaaatcggccctggccgccctggacgccaaggaatacccgtcggccatagcccagctcaccgaggccatggactccaacgaactgccggccgaacagacccacctgtttctggccgcccgaggctacgcccgggccgccatgggcgactataacgccgccattgacgattattccaaggccgtccaactcgacgccagctacgtgtcggccatctacaaccggggcaacgcccatttcgccctgcgccactacgaccaggccatcgacgactactccctggctctggagaccgacgccaaggacgccaagctgcttaacaaccggggttcggcctggtttaaaaaaggcaacctgcaaagcgccatggccaattttgcactggccatcgaagcttcgcccgacgaccccgacctctacctcaatcgcggcaaggtctacgaagccctgggcgagccggacaaggcccgggaggatttcttgcaggtcaaaaagctcgatccttccgccaaaacccccctcgattagccgcgtttattcgcgaaacccgctgaattcgttcttgttgcggaacaaccgttcggtatcggtccggcggtcgcttttggaggaagggccgtcgaccggcggcgcggctttcgtatgtcaatcagacatgttcccagcgccagacggcggcctttcgacgaacgggcgcgcgatttgtcggccagccaagtcgctcgcccggcaggccgggcatgaacgccatcctccgtccccgatgcctcgtcgctgcccgaatgcgacggcgtttcggcggaaagccgtcttgtttgggctggcgagagcggtcgccggccagtcgaaacagggactgcccggatttggccgaggcgatccaggctcccgatccgacgccgcttcatgggcggcaaatcgtccttgaccgggacgctcggtcgtgcttgagtctgcaatagggaccagttcccggaggaggctcctatgggtatgcggaaacgttttctggcggccgccgtggccggcgcgctgtgcttggtggtcgaaatcggaccgatgcccgtcgcccaggccggcgatcaggggatggtggtggcccagtggcaacagccgcagcagcagggcgggcaacggccccaaggccagcaaggcggccagcggcctcagggccaacagcaacagcaaggccaaccccagcaacaggggatgccccagcagcagggcggcccggccaacaattcctgcgtccagagctaccaacgctgcgtcatgatgtgcgccggggtcggcaactgcgtcaacaactgcaacatcggctacgccgtctgccagcaacagcaaggcggcggcagttagcgtgtgagcgtgagcgagtgagagagtgagaagaaaagatgcctccggcggctgggggcctgaggcccccagacccccgcatggaggaaagtttaaagggctttcgagctgcgtaagtttgatttgtggctgaccatgaatcgaactgtagaaacgtcaaagggccgcgctagcggccctttgacgtttaaaacgcatccgccgtccgagggacctagtcgatgcggtaatggcagcccagcgaccggcggttctgcatggccgcgatggtgatggtgtaggccgcctggcagccgtgaaacaggtccacgatggccttgctgatgggcgtttcgcggtagaagtcgtggatatgcttgttgagttcgcgcagatcctcgaaagcccgcttgagccgggaactcgaccggttgatgccgacatagttccacatggtgttgcggatggtggcccagtcctgggcaatgagcgccgggtcctcgttgcggttggagccggggctgacccagtccgggatgctgtccagcagccgccggccgatggccgccttggagccggctcgcttggccacgtcctggccggcgctgtgcccccacagtacgcattccagaagcgaggtgctggccaggcggttggccccgtggatgccggtgcaggcgcattcgccggcggcgtagagccgctccagggtggtgcggccggcgctgtcggtgagcaccccgccgcagaagtagtgggccgccggcaccaccggaatgggctgcttggtgacgtcgatgccaagctgcagacagcccttgtaaaccgtggggaagtgctcttccaggttcttcacgtagctggccacgtcgagatagacgcagtcctggtcggtcttgagcatctcggccaggatggcccgggtgacgatgtcgcgcggggccagatcggcccggggatcgtagcgctgcatgaagggttcgccggccgcgttgacgagcctagccccttcgccgcgtagcgcctcggtgatgagcaggcggcgttcggcccggtgaaagagcgtggtcggatggaactgcacgtattccacgttcatgaccttagcaaaggcgcgcgaagccatggccagggccgagccgatggaggaacgggtgttggaggtgtgcaggaacagccggccgcagccgcccgtggccaacacggtgaaatcggccagaatggtttccacctgtcccgagacctcgtttaagacgtaggcccccaggcattggttcaggagctggtacttgaattccagcaaggtggcgtggtggttggaggtgagcaggtccacggccgtgcggcgggtgaggatcttgatgttggggttggctttgaccgccgccatcaggccctccatgatggctcggccggtgcggtcggccatgtggaggatgcgggccacactgtggccgccttccttgcccaggtggtagtcgctgccgccgcccttgtggtcaaaagggagctgcagcttgtcgatgagcagttcctgcaccacctgcggcccgcgccgggccagatacttgaccgcgcgcacggagttgtgccgccagccgcaggtgagcatgtcgcgctccagaagctggggcgagtcgtccgggccgcgatagacgatgccaccctgggccagggcgctgttgccgtcgtcgaggtcttcgccggaagtcagcagaatcacttccaggccggcctcggccatggtcagggcggcggtaaggccggccagtcccgagccgatgaccagggcgttggcgtgcatgcggtagaccatggggcagcttcctccttgggcgcgctcggggctggcggggcgtcctcgcaaacggtcagataaatggcgacaatgcgctgttgcacaaatccattttcaaaaaagggcagcttgtggccgccggctcaggccgaggcttcgagcatccgcgtgacggccaacgcggccggggcgcgcacggcttcatccacgcgcaccggctcggccgtgtcgagattttgcagcgttgtcagcagattggcctcggtgcctttggccatgttggaacaggcgctcagcgccaggggccggatggtcttttttccctgatactgcttggccagccgcttgaccagattgatctccgtgccgatgacgatctcggaaccctccggagcctcggccacgtacttgatgataaacgaggtcgagccggccgcgtcggcggcggacacggtctcgggcgaacactcgggatggaccacaatgcgggcctcggggggctgcacgcggatggcggcgatgtcccgggccttgaaccgggcatggatgacgcactggccgggccacaagagcacctcggccttggtggccgccgcgaggtcgacctgggagccgccgccgcgcacgtccaggatgtggcgggcgctttccggcacgcccagggtgttgcaggtgttttgcccgagcatcttgtccggcaaaaagagcacgccgcgtccgtggtccagggcccacttgagcattttcggcgcgttggccgaggtgcataccgccccgccgcaggccccgaccacggctttgaccgccgccgaggagttgacgtaggtcagcggcaacacgtcgcgcccggcctggcgcaggcgcgtcagcacggcctcgaccaggggagccggggccatctcggacatgacgcaggccgcgtccggggccgggatgtggatgcgctggccgggcgcggccagcatggccgctgtctcggccatgaaaaagacgccgcaaaacacgatgtccctggccgacagcgaagcgatcttgcgcgaaagttccagggaatcaccgagaatgtcggcgtgggccaccacgtcgtcggtctggtagtggtgggccaggatagccaagtcgctgccgcgttcccggcggatcgcgtcgattttctgggcggtttcggcggtcatcatgcggtcgtctccttgagcagcatgcttaagtcggcgcttttggcggaatgggtgatgcggcccacggacacgaaatccgggccgagcgcgccaatgccggccagggcgtccaggtccacgccgccgctgacttccgtttcgatgccggccggcaccatggccagggcctcgcgcatggtcggctcatccatgttgtcgagcatgatgcgcttgggggcttcggctatggcctgggccacttcggccagggtccggcattcgatttccacgggcggcatggattccatatggccttggtaggatttgcgcaaggcggccatggcttgggggatgccgccggcccggtcgatgtggttgtccttgaacatgagcatttcggccagatcgaggcggtggttgacgccgccgccgcagaccacggcgtatttttcgggatagcgcaggccgggcagggtctttcgggtgtcgagaaggcgggttttcgtgccggccagggcggccacggccttggcgaccatggtggcgatgcccgagagatggcagatatagttgaggatgacgcgctcggccttgagcagcgtgatggccggccccacgatttcggccaccaccatgcggttggccacgcgctggccgtcggcggcgaaaagcgtgaccgagcaagcctcggcctggcccatgcgctcaaggaccaggggggcgatgggcaagccggccatgacggcttcttccttggccacgatggcggcggtcaaccggtcctcgggggcgaaaacggccatggcggtcaagtccggcccgtcttcctccagggcgaggtcgatggagcggaaaagatagtcccgggctttgccggaaaaatagcgttcgaagcgtaagtcggtcatggcgcaccgcgtcgggtagggggcggcgtcggggaaatgcctgcgcgcgcccaggtgtcgggggacggcgggcaagaaccgcgccgacgcggtcgcaagcccttgcccttggcaaaaagccgcgccgccgcgaaaaaaatagcttttttcggcccctgccacaagaccggggcgtggcgacttttgaccgaatcggggcttggccgtgtcccagaagttcccaggcggccccggggcacatctcggcggccgtctgccaagaacttgcgcttggcgtttgcccgacaatgtgggcgaggccaagtgccggacggttgcgatgctacgcgggcaagggcatggccctacccatggcgcttgcgaagcctggccagcctggcggccaggcgcggttcctggccttgctccttgggcatgtagaactggcggcccaccagttcctcgggcagataatcctgctccacccaggcgtcgggataggcgtggggatacatgtagcccttgccgaagccccattccttttgcagcttggtcgagggattgcgcagatgcaggggcacgggcttgaccccggactgcatgatttcctttttggcggtcagataggcggcgtaggtggaattgctcttgggagccagggccagatagaccacggtctgggccaggggaataaatccttcgggcatcccgatgcgctccacggcctcggcggcggacacggccaggggcaaagccatgggatcggccaggccgatgtcctcggaagccgaaatcatgagccggcggcagcaaaaacgcgggtcctcgccggattcgagcatgcaggccaggtagtacagggcggcgtccgggtcgctgccgcggatggatttgatcatggccgaggccagttcgtagtgggagtcgccgtcgcggtcgccccgggccagggcctcggggaggtgcttgcgcagttcgtccggggcgcgtttgtcctcggacaaggcggccgtgtattcgaccagattgagcagcgtgcggccgtcgcccgaggacagcatggcgatggtttccaggctctccttggccagggccatgccggcctcgcgcgccccgcgctcggccagaaccatgagctggggatgggtcaacggccccaggcgcaggacgtgcagccgggacaggagttggcgcgtgaccgaaaacgacgggttctccgtggtggtggccaagagcacgatctcgcccgtttcgaggatgggcaggaaaaaatcctgctgcgccttggaaaagcggtgcagctcgtccaggataaggatttccttgcccttgatgagttcgcgcagggcggccaggcccgcttccggggcgctgacgcgcacgtagggccggcccttggcccgggcgagaatgagggccagggtggatttgccgcagcccggcgggccaaagagcagcaggctcggcaggcgcggcgcggccagcatgttggtcagccgcgagatgacatgggcctggcccacgaagtcttcgagcttggccggccggatgcgctcggccagggggcgtttttcgtttccgagcaaatccatgcaagtcgcctcgttgatgtggtcgtgggggaagcctccggcggccaaagggcgctgccctttggaatcccgtttcgggttgggctggagactctcctccgtggttggcgaaggttttcagtcggcgaccgtttttttgtcgttgcgtacgactcatcaaggtatcgggactcgttgaagtcaggtcaacggcagtctccgtcaagtccaattgatgcttcccggccgacacaaagccaattcccgtcgaaccccgttatactttttcccatgtggggggtccgggggcctcaggcccccggccgccagaggctcctatctcgcctcggacgctaggcccagggccagcacggccagggcggcggtttcccagcgcagcacgcgcgggccgagggtgaccgggataaacccggcagctgtgatcgtcgtggcctcggcgtcggtgaagccgccttccggcccgacgacgcacagggtgtcgccggcggcagccagatcggtcggggtaagcggccgggacacggccggatcttcccaaaggagaaatctgcgggggtaggcttgtccggccttggtcaggccggccgcaccgccgggcacgcaggcgagcgtcggcaaaagtgccgcgccgcactgtttggcagcggcgatgagcccggccgtccaggcttccttggggtcgccgggcattttgccctgtgtgcgttcggcctgccagaagacgatgccggccgcgccgagttccacggccttttccaaaaaaaagtcgcgccgggccgagcgggaaaagccggccgcgatgtgaagtcgccgcgcggggggcggcgtttcttcgagactctcggggataagctccacccggtcgcgcccgacggtttcgatgcgaaaaagcccgtggtggcccgtgccgtcaaaggcgcgcacgagttcgcccgggcgtttgcgcagcaccttggcgcagtggctggcctcgccgccggtgagggaaaagggcgcggcgaactgctcgggcggaatgaaaaaggcgtcgggtcggcccacgaaaaaagtccttggctggcgttgtcacagcgtccggtgacgaaagcggccgagaggcacaccccccggccgcaccatcatgctcccgatccaacccctggcttccattgcaggggtccggggggatcatccccccggccgccggaggcatcttcctctttccgcttaccccgtaatcgcctttctggccgtgccgtccttgtaaaacggcagatcgcggcgtttggccggcagttcgacccgggcggccttgaccacgaagtccttggcctcggcggccgaggcgtccacataggccagagccacggcgtggccaaggctcggggcgaatgaggcgctggtgaccacgccgacggtcttgccggacttgtcgcacacggcgtcgccgtggcgggcgctgcggcggccgggaatctccaggccgatgagcttttggcgcaggccggcggccttgcccttgccgacgtagtcggccggggaggtgagcagccagccgtaaccggcctcggctggggtgtgctcctcgtcgaggtcctggccgtagaggggatagcccatttccaggcggatggtgtcgcgcgcgccaaggccggccggggccacgcgcgggtcggccgtgatggcctcccacagggccacggcgtggctggccggcaggaacagctcgtagcccagttcgccggtgtagccggtgcggctgaccatcatcttgacgccctggaagtcggtccagacgaagttgaagtatttgaggcccgaaaaatcgccgggcaggcggtcgcgcagcacctcgaaggccagcgggccttgcaggtcgatcttggccgtctcggccgagacgttgcggaagttcgagccggccggcagccggcccttgatagtctcgaaatccacgacgatgcgcgagccgttgaccaccagcatgtagtcgtccacgcccaggcagtagatgatgaggtcgtcgatgacgccgccattttcattgaggagaaaaccgtagcggcatttgcccggggccagggtggccaggtcgtgggtgacggccttgcccagggcctgggccgcgccgtcgccggacagggtgaattcgcccatgtggcagatgtcgaagacggcggctttgttgcgggtctgctcgtgttcggccaggatggaggtgtactgcaccggcatgtcgaagccggcaaaggggaccatcttggctccgtgctcgcggttccagtcggtcaggggagtgggggtgggcttttccacggcaattggctccgggtctgtcggaaacggcgttccgacgtcaagggtgtacggcggccgggccgccggtcaggttttgttccgattgcagttgcgaagtgcaataatataacaaacaacatgtttgcataattatatattttataacgcaaccatggttgcgttataaaggcagcatcagctctgggccaccagcggcaggacgatgccctgctctttcttggccttgcggatcatgcggaactcgtcgagcagggccaccagccggccgtaggtcttttttacggacaggccgtagggcgaaaggtccaggtcctttttgcgtatgtaggtccgaagcaggtagctgtcgtttaagatcatatcgccaagggacagaacacgctcgaccaaggcatcgaaatagttgacgatctcgaattttagatcatttaagacttcggtgaaaagggccagcattttggcgtaggtcagccgttcgcccttatagttgcggtcctggaggtcttcgagcatcttcacttttctggcctgctggatgtagctgtatttgctccagacttcttggtagacatcgcgcaggttgctgaagtcgtcgtagtggtcggcacttaaaaggtagttgtcgaggaccttgaccacgttggaatagaaatcgtcggagtagccgatgatgcggcgctggtgcttggacagccaagcgtagagaaacttgagctttttttcgtgggtgtcggtattttccacgatttcgttgcgcttgtagacgatgcggccggagtattcgccgcgcacgatgtcgtttaagcgcaaaaacaggctgtaggtgtccttaacgaggttgaggcggtagtagctgcggccggtcagggggtggatgacctcttgggaggccacggacagggcgcgatcctggcgcacgttgttgggatcgtacttgtgctggcggtagaccacccgggtgatgaccacccggcggtcggggtcgatgaagtagccgccttcggccaaggccttgaccgcctcggtctgggacttgtccacggccaccagggcgattttttccacgcgcggataaaagcgcgcgtcagggtgggagtagagcgtggtgatggcccggtcggtctggcccaggacgcggaccaggaatttttcgcccatgcggaacagccggcgggcgaaaagcgccgacgaggtgcgccgttcggacacgatggggaagccgtaaagctccatgagaaactggtagacgaagccgcgatggcgctcgtagcgccggtcgtcgcccacggcgaatttcttgatgttcaggccaaaccgcttgagttcggtgtcgaggtaggacgggaacgagcagtagacgccggagaggtagaagtcgttttggctgtccatggacagcacatgggcccggtccatgtcgaggatggtggggagcagggcggcgtagttctccaggctcgtgacgtcggtctcggaaaagcgggtgcggaaggcgtcctggctggccttgggcaggtgggcgcagaaagtgcggatgttctggctgaagatcgaggattccagcggacattggtcgcggtatttttcgtcggcgtagtcgagcaggcagtgcaggatgtcgtactggaaaatttcctggaaatacttgagcggtcgggccagggcgaccatggaaaagcccggcagctccttgtattcgtaggcgtcagcctcaaacgaaggcagcaactcgcggaaatccaccaccggatagttggcgtgttcggcgtaaggcttgagcaggcactgcttgatgtggatccagtcgagataacggcgcagatcgggcaacgtctggacgcgcaggatttccccttctctggcgcggtgctggccgtcgaggaaaggggcttcgggaacctgggaaaaggcggtcgtccagtcgaagatcatggccgctccatgggcgggttgtcggttgccggccgccggcgggctggccgccgctgccgaaaaccctttcttagcctaatatccattaggaataaagccccgcagaggcggtggcggttacgcggggtgaacgatttgacgcaggcggtccgtctccgtaaggtgcgcccaagacggaagcccctttgcgggcggccgttgcccgggctgccagaggcccggccaaagttgccatttaacaagctgaatttataatccgtagttggaaaagcctgccggctttttgcaagcgagacaccggccgccatgcagcagaccgccttttacgagcaactgctcgacattgtcggcaacgtcttcgacgcctattcggccgtgctgtttctgcccgatccggccgagcccggggtgtgccgggcggcggccgcgttcagcctgggcgaggcgctcaatcgcgaggccgccatcgccccgggccaagggctggttggctggatcatccgcgaaaaaaagccgcttttgatcagcaattttgaccagcaacgcggtatcctgggctattaccggggcggcgaggaggagcgcatccgggcctttatgggccatcccgtgccggccaccggcggggcgctttgcatcgacacccgcaagacctatgcttttgtcgaaaaagacctcaagatcctgtcgcagttcgcgcagctggccggcaaccacctggcccgtagccgggaagtggcccaaagcctggtcgagcacggtttttacaaagcccaccagcgcatcgccctgctgcacaagacccaccccaaatgggccgcttttcgcgaggccttcctgtcgattttggccgaggcggcagggtttcgccacgccatcctggccgtgcgcgacgaatcggggcgctcgtattttctggaaggcgtgagcgaaagcccgtttctgggcggccgcgacgtgcccggccggttttccgtgggccagggcctggtcggctgggtgttcaagaacaacaccccggtctataccggcgaaaaggacgaagccagccggttgccgcttttcggcctggacgtggcgaccatcgattgcaaaagcgtcatctgtctgcccatcgctttttccaaaaagacccgggccgtgctcaccctggccgatccccggcccctgcccgtggccgaggacctcaagacctttgtcggcatggtctcggaaagcctggccttgtttctggaaaacctgcacctgcgcacccgtctcggcagcccttcggcgtagacttttcggccgcgcccatctaccatgggccaattgtccggcaatgggccgtcccctttttttcgaacgccaacgcgagtgtgggcatgtttttcacgaaactgtttcggttcctcggcaaggacctggccatggacctcggcacggccaatacgctgctctataccgcccaggacggcatcgtgctggctgagccctcggtggtggccatcgacacccgtaccgacgaactcattgccgtgggcgccgaggccaaggagtaccttggccgcacccctgaacgcatccgggccatccgacccatgaaggacggcgtcatcgccgacttcgacgttacccgggccatgatcgcctttttcgtgcgcaaggtgctgaccggttttcgttacgccaagcccaagatggtcatctgtgtgccgaccggtatcacccaggtcgagaaacgcgccgtggtcgaatcggcccagatggccggcgcgcgcgaggtcaagctggtggaggagcccatggccgcggccatcggcgcgggcctgcccatcgaccggccttccggcaacatggtggtggacattggcggcggcacaaccgaagtggccgtcatctcgctttccgccatcgcctacgccgaatccgtgcgcgtggccggcgacgaactcaatgagaccatccagcgtttcgtccaggatgaattccaactgcttatcggcgaaaacatggccgaggagatcaagatccgcatcggttcggccatgcccctgcccgagccgcgctccatggacgtgtcgggcaagtcgctcatcgacggcacgccgaccacggtgaccatcaccgacgagcagatccgggaagccatccgcgagccggtcaacatcatcgtcagcgcggccatgaaggcactggagaaaacgccgcccgagctggtggccgacatcgccaagaacggcctgctcctggccggcggcggagcgcttctggccgggttggatcagcgcatcagccaggagaccaatctcacggtggtcctcgacgacgatcccctgaccacggtggtgcgcggcaccggccgctccatggtcgaccgggaccgctttaaggacgttttcatcaattaaggcgctgccgcgttgcacattgccccgaggcagaccgtccgaagcgcgggcatggtcccggcaggcttctcctcgaatgaacttccgctcccgggtgtcgcgtccatgaaaagcgcataaggcatttcgtaggcaacatcttaaaaccataaatttttcttaaaaaactattgtacttgttgagggacgctacatgagagcgcccatcccccccttaacccctttggggggtccgggggcctcaggcccccggccgccggaggcattcttcatcttcttctctaggacaaccacccatgtcgaagacggaaacagcacgcctgatggaggccgtgcggcaggcggtcttggcctccggcgagcgcatcaaggccgattgggacgccccgcgcgacgtgcgtttaaaaggccgcatcgatctggtcacggccacggatctggccgtggaggagggcctcaaggaggctctggcccgggtgttgcccgaggctgctttcctggccgaggagaccgccgccagaaccgtgttgtcggggctgacctggatcatcgacccggtggacggcaccacgaatttcgcccatgggtttccgtttgtctgcacgtcggtggcgctgtacgacggccaggagccggtggtcggctgcgtcaacgcgccgctgcttggccagtgcttcacggccggcaaagggttgggggcgtattgcaacggcgagtccatccgcgtttcgcggaccgaccggcccgaagcggccctggtcgccacggggtttccctacgccatccgcgagaatctggacgagatcatggccgatttgcgggtcatgctggccgagacccaaggcatccgccggccgggttcggccgccctggatttggcttacgtggccgccgggcggttcgacgctttttatgagctggcgctcaatccctgggacgtggcggccggggcgctccttgtggccgaggccgggggcagggtgggcagctatcgcccggacgggccgtattgcctgggcgatttccggatactggccaccaacggcgcgctccacgcccccatgctggccctgctggccgattgactatccccatttggggggtccgggggcctcaggcccccggccgccggaggctcttcagattctatagcctcggaaacagcgtgcccttttcgaaaaagtggaccacggccggggtgaggcagtcgcggtagtcgcgcaccagggcggccagttcggcttcgtccacgaacatgcctccggcgagttcctcgggattggggcgcggcgggtcggtcaggcggccggcggaaaagacggtgacgaactcgtaggcagtctcgcggctggcctgggcggcgtccacgggcgtcagcgtcttggcggtcaggccgagttcttcgtggagttcccgggcggcggcttcctcgcgggcttcgccggcctggacgtggcccgtggccgagagatcgaagcggccggggtagaggtccttgtgcggggcgcgtttttgcagatagagccggccggcggggtcgtagaccagcaccatggccgcgcggtggtaaaggccctgacggtgcgcctcgccaaggggcatgacgagcagttcgcggtcgttttcatcgaccacgtccaccatttcctcaaccggtttgggattcgcttttttcgccatggcttggtcctgtggcggcatgatgccaggagacgccggaaatgcaaccggatgcagcgagcctcgcaagcggggaacaggcagggggacgggccgcgccgggcgaaccgacgcaacaggcgggcgggcctcgaatcgtcgcgcccgaggccctgggcgtggccgacgccgtagccctggccgctttggagggggcctgttttcccgacgcctgggacgcttccgcctttgccgccgccctggcccggcctcatgtccgggcttacggtattcgcgacggcgaccatcttgccgcttatggcgtgttccacttcctgggcgacgagttcgaggtgatcaacatcgccgtggacccggcccggcgcgggcagcgtctggggtctcggcttttcggccatgtcttgcaacaggccgacaaagcaggcatgttgcaggggcatctggaagtgcgcgccggcaacgagccggccaaacgtttgtatcttcgccacggtttcgccgtggtcggcgtgcgaaaacggtactaccccgacaccggggaggacgccctggtcatgcggcgtacggccggccagggcgcaagcgccaacatataacccctctcaggcacgcgttaaggagttcccatggcccttatccgcattgatcaaatcgatgtcgccggcaagaagctgctcatcagggtggactacaacgtgccgctcaaagacggcgagatcaccgacgacctgcgcatccgggcgagcctgccgaccatcgaatacgccctgtccaagggctgctcgctcatcttgtgctcccacctcggcaaggccaagggggcgccggacgccaagtattccctggccccggcggccaagcggctctccgagttgctgggtcgcgaggtcaagatggccccggattgcctgggcgaggcgacgagggccatggccgcggcccttaagcccggcgagatcctcatgctcgaaaacctgcgcttccatccgggcgagaccgccggggacatggactttgccaaggacgtcatgtccatggccgaggtctacgtgtgcgatgccttcggcacggcccaccggccccatgcctccatggtggcttttgccaaggtagccaagcagtgctgcgccgggtttcttcttatgaaggaatggcagttcctgggcgaggcagtggaagcgccccagcgcccgttcgtggccgtttcgggcggggccaaggtgtcttccaagctcggggtgctcaaaaatctgctcaccaaggtcgacgccatgtgcatcggcggggccatggccaacaccttcctggccgcccagggctacggcgtgggcaagtccctggtcgagcccgatctgttcgaggcggccctggagatcatggccgaggccaaaaagcgcggcgtgggcttctacctgcccgtggatttcatcatttccaaggacgcgggcaaacccatggccgagatgcagccctgcggccaggtgcctttcgccgccatccccgaggacgccgtggccctggacgtcggcccggtgacggccgggcttttcgccctggtcatggacgccgccaagaccgtggtctggaacggccccatgggcgctttcgagaaccccgcctttgcccagggttcctacaccgtggctcatatcgtggccggggtgcgggggctgagtatcgtcggcggcggcgacaccgatgtggtggtgcatcaggccgggctggccgacaagatggccttcatctccaccggcggcggcgcgtccctggaatttctggaaggcaaggaactgccggcctttgccgcgctcaaggagtgccagtcatgaaaaagctcatggccgccaactggaagatgtacaagcttcggggcgaggcgggcaaaacggccgccgagctggtcgccgccctggccggcaagctgccggccgaccgcgaggtgctggtgatcccgccctttaccgccctggggaccacgggcgaggccctggccggccaggccgggttcgccctgggcgcccagaacttctatccttcgggccagggagcgtttaccggcgagatcgcgccggagatgctcctggacgcgggttgcacctacgccctggccggccattccgagcgccgccatatcctgggcgaggacgacgccatggtcgggcgcaaggtgggttttgggctgaaaagcggcctgtccatgatcctgtgcgtgggcgagaaggtggaggagcgcaaggccggcgaattggaagccgtgctgcgccgccagatcgaggccgggttggccgaggtcggggctgatgttgggccggaaaagctggccgtggcctatgagccggtctgggctatcggtacggggctcacggccggaccggaggaagtggccgaggcccacgccctggtgcgggccatgttggtcgaacgattgggcgctgtgggcggccaaatccgcattctctacggcggcagcgtgaagcagggcaacgcggggcagctattagggattgacaacgtcgacggagtgctggtaggtggcgcaagccttgaggctggaagcttcgcggcgattgtgacagcttgacgaacacgtggacatgtccgcgaaaataacgggaaaaatcagttgacaactctcataattactgtacatgtactcgcctgcgtggccgtgatcatcctggttttgctgcagtccggcaaggaaggcatgggggtgatcttcggaggcggaagccaatccgtcttcggcagtacgggggcaggtggactgctcgtcaagctgaccgcgctttttggagcgatctttcttattacttcgcttgcctacaatgtgtattcgggctcgcacaagcgttcggccaaatcggtcatgatggacgccagcggcgctccggtgcagattccggcagctgtggaaggcgccaaggatgcggaacccaagaagggagttaccttcgaggatgttccggccccggcggctccggctcctggcgcggcgaagcagtagagacgatatttgccgaagtggtggaactggtagacacgccatcttgagggggtggtgggccatgcccgtgggggttcgagtccccccttcggcaccacaattgtaaaagggtttgagctgtaagggcttgaacccttttacttttttcaggggttaaaaacggccttttttcgatcccggcccgcgaaaaacccttgaaaatcttgtggacggtcttgggtacaaagtgttggtacaaaatgccaacgccaggaggcccccatgcgggcttcaccttcggcttatccgaccctctcccctggtacaaaatctccttcccatctggtcctccggaatggcacctggcatttccgtatggccgttcccactccttgtcgcccgcgcttaggcggactcaacgagttcaaggcgtctctgaggacgggagtgctccgcgaggccaagttgttggcagggaaacttgcggcaaacgctcacctcgtctatcgtcatgtccaaaaggactccatcccaatgggaaacttggataagaagaccatccgggccttggctaagaagtggcttttggaggggctggattattacgaagccgagcatctgtctcgggataagcccgtgaacgcagagatgcgtgaggctcgtaaagcgtcgcttgagagcatggcggcctattaccaagagcaattggccgcgggcgatttttcatgcgtcaatcaagactgggtggcggaacgcttggagcgggagaacctgccgattccagagaaggactctctcgaatttaagatgctgactgcagagttcatgaaggcgacggtcgatctctccaagattcaggcaaacagaacgataggtgattactcagattcattgactgcagatcctattccttcaaattctgtagaagatgtcgcagttgtcaggagtgccgacatagcaagcaagccagtagagccggcaccggaaaatctgttgaacgatgtccttgatagatatatagaagaaagaattcgagcaggtgcatggacagagcgttcccaggctgattttctaccgaagctacaatttttcaagcagctagtcggaaatatagccatagaaaagttgagtcgagagcatgtcagagacttcaagcttgtcattgataggctgcctgctcgctatggtataactaaaaaatacaaagacctcagccttgaagaggttcttgaggcttctatccctttagacgataggatgtctccgtcaagtcttagtaaatactatgggactataaatagcttcttgatatggttgaagaagaattatgatggcgtcggtgaaggactttctgatgttctggcaatcaagatcaatcgtcaagttgacgctctgcgagatgtttttactgaggcggaccttgccaaaattttcaagtccgagatctatgcgaaggctggtgctgaaaagtcttttaaatattggataccgctgcttggattgtatacagggatgaggcttgaagagatctgtcagctttacgttgaagacctggttgtggaagacggtttgtattgtctaagcgttaatgacgacaaagataaaaaaataaagacgcctgctgcaaagcggctggtaccgctgcatcctgatcttgttgacaagttcaaatttccggactttgttgctgaacaaaaagcgaagaaaaatgaacggttattcccagagttgcggaagcaaagtggacgattttcgcattatgcatcccgttggttcaatgccgatttcctagtaaaggtcggggtcaagagtggagatggcaagaaagtgtttcattcctttcgccataccttcgcaaatgcctgtaaagttgccggagtagatgaatacaaagccagagaagtccttgggcatgatgtctctggcaaaagcataacgtacggcagatacgggaagcggtattcagtggcaattttgatgacggatgtaattttgaagataaattggattggcctatcgaattggtcgagttgactggaaaaaggattaatatggtagtctttaatgaatcctgtggtaaaattcgccaaaagtatgaaagtagcccaataaagcgcagagaattattactggcattgtttatgacgcgctatttgttttgttctagaaataatattttatgtatatcaaggcaaaattttgcagataaatttaatgaaatagagcgattgccaaataagctttggcatgatgaggctaaggattttatgatgaattgtccagattttagagagtatagcaaaccaatgtgtgatatgttttcatattatagatctaagaatagcagaacgttttttaaagcgttcaattcagttgatataaatatggtaaaattaagaaatgaagcattaaaagactgttatgatgtaattggctacaagataaaagatattggtgcaaggcaagctattctatgcaatgtaagtgaattaagtttgtcgacgatcaaggcggctttgctaggaagggttacaagtcgtggtgttacgaagcgtgaaagtcgaactatgttgagagtggcattgtttgaaaaaatatacaaagaatatgaattaaatgtcctggaaaatctgcttttagagtatgacgcaattatatgtggcgacaaagatgaacaaaggtctcatgatattactcgaaacactattattgaacgtataaataaagtaaaagcaggcgaactaaagaaaagtgtagagacatcgtttgtgatttaggtggatttgtcggtgggattgttggactaatttgttggaggttttgcggcgaaacaaaaaaatagtaaatttagaatgttgtatgcgacgtgttgaggtgtccggggacgcccgcgttcgaccatcccgcgccttcgctcactcgtgactcaccgtttggcgaaggcccgctctaaaaaatccttctccatgtcaattgaccgatcttggcgtggagattccgaatttcggcggcggcatccttctgcacggtcgctgtcagcaaggatttcgattcgacgctgcttgaagggaaatccctgcttgccacctatgtcactcagtttcccgaaaccgggctcaaggtcattggcttggagaaggccttttcgtttcagatcgaaggcgtgccgattcccatcgtcggcgtcatggacatggtcgaagaagatgccggcggcaatatcgtcatcgtcgaccacaagacctccagtcgttcctactcctccgatgacatcgacaagagcctgcagctgaccatctacggcatggctgccaaggccaacgggtatgctgaccgggagatcatgctgcgatttgattgtctcgtcaaaaccaagaagcccaagttcgagcagtattacaccgtcagaactgaagaagatgagcagcgagccatgaagaagattcaggctgtctatcgtgggatcatgcaaggggtgttcattcccaatgacacgtcctggaagtgcaagggctgttcgtatcagctgtgctgtcgggattggttcgcaaattgaacaaggagggatcatgtcccttaacgccaaacagttggaggcggcgcagtttcataccgggatcgcattggttgtcgctgtccctggttccggaaagaccaagacgatgacggaacgaattggccggcttgtcaatgaccacggcgtcgccccggagaacattctggggctgacctacacccgtcaggctgccgagcagatgcgggaacgattggagttggttctccatggtgaagccagtcgagtcaatttgtataccatccattcgttttgtctgcggttgctcaaatccgaaggccgatacttcaatattgtctcaggctccgagcagatgaccatggtggcgacgattatgcgttcgctagggatcaaagacttggccatcggtggagtgttgcaagatatcagcttggccaagagcaacctgatcagcccagaagagttcattgatctctacggtgaagatcagtcgaagcagaaaacggccatggtgttcaaggagtatgaggagcaaaaggccatccggtatctctacgatttcgatgacctgctccttcaggcgtatcggtttctggcccatgagggcggcgctgaaaaataccatgacgtgtatccccacatcctcgttgacgagtaccaggataccaacccggcgcagttggccgtgctccaggcgctcatcgaagataccggccggggctcgttttgggcttgcggcgacgattggcagagcatctacgcgttcaacggagccagcatcgggaacatccttcggttcaagcagatattcccctcggctcaggagatcgtgctcaacgtcaattaccgctccaccccggcgatcttggccgcgtgtcagaagctcatcgatcataaccagcggaagatccccaaggagcttatcgcacacaagccaggcggcaaccatgacctgtttgtcatcgacaccttcaatgaggaagaggaagcgtgtctggtcgccaatgaaatcaagcacctgagtgtgtctgatggcacggcgtatagcgatatggcggtgctttaccgagccaacttccagtcggagatattgcaaaatgtctttgtgagagctggcattcccttctacatcgacaacggcatgagcttctacgagcgccgtgaggtcagaatcctgctcgattatctccggtttattgaagatcccgattcggtggccggagatgaagccttgcaacggatcatcaatgcccccaacagatacctggggaagaagttcatggaacaggtggctggggtggccaatgaggcatcctgcagcctgtatcaagcccttcgcaccatggacttcgacagcccctacatcaggaggaatgtccatgagttcgtgcggcttatggagtcattcattcagaacgaaggggagatggggccggccgaggtgttggcgaagctgcgccagcggttggattacgaccggttcgtcactgacaaggatattccctctcctgacaaccaggccgtgctcaacctgaaccagctgctgcagtcggcggcccggtacgcgtccatcagtgagtttctgacctatgtggcgacggttgaagacgaaacctgcagccgtgaccccagtggcgtgaagctcatgaccatccacaaggccaagggactcgaatttcccgtggtgttcgtggtcgggttggtcgaaggcatcatgcccaccaagcgcggcgatttggaagaggagagaaggatctgcttcgtcgccttatcccgcgccatggatcggctctacgtgacctactcgcacaactacctggggcagcccgccaagaggtccatcttcattgatgagatgaccggcgacctggctgtccttgatcccataaaacagattccaagcccatgatggaggcttctatgtcttatgaattgctccatttcagagattccaagatggtcatcgaggaaaaggggatgaccaatatcgttaaggataccctggggtacgtcgatgattggcttcctgagtcgccgtacaaagggcgtcggctcaagagcagcctggaagattgcggctggcgtgacaacgggaacctgcccatcatcgaaggccgccggtatcagtacaagggctgtctccagcgcatcgccatcgaggccaacttccacgcctacgagtacatccttgaagggctcgttcggctgcagctcgggtacgacctgggaaaaattgatgtcggcttgttgctgctcacaggtgaacgcagcgccaagagcccgttcggttcaacaaaggaattggtgatccgagaagtcgagtcgctgtacccgaccatttcgatgccggtggccgtggccattttcaacatcgaagcgtcggcggccaattccatgctcccctgcgaaccggtggtggatgttcatgggcatagtgtcgtgtcgtcgagcagccaggaagtgcggtcgtgaaaggcaagctgacgaccctggggaaggtgatggagaaggtggaacggatgtccgtaaactgccatgaccagattgtgccggtgcgccatatcgaattcaatgacctggaatcgattcgagtcggcactgaggtgcatgagttgcggcacatggcccagcgatcgttgtcgtatcggttgggtgtgccgctgcaatatctgaagaagtgcccgcccgagttgcaagcgcagaacctgaaccattggctggccagggaacgcaatgaggatctttatcttcgattcgacggcgatgatgtcagggccgtgttcacccctcgctacgtgcctgtggataacatgacggttttgcacaaacttgccgagatgggctttggcgaggagcttgaggtgcaatgttacctggatcacgagttcatgtcgctttccatccttgaccaagggcaggaatttgctgttaatggaaacgatcgcgtaaggcccgggatttccattggcaattccgagatcggattggcggcgttgtccatttcggcgttcctgttgcgactggtgtgcaccaacgggctcatttcgaagacggaagtcgaggcttcgtatcgccacatttcgacgcggattctggatgagttccccacggccattggcgatgtcggtgccaagttgttggatgagaagcaaaggctccagttttccctggagtcggaagtgaaggagccgattgcgaccatgaagtcattcaaccgccagtttcagcttgggaagcaggaagtggaagccgttgaatgggcgtggccgcaggagcagggcgagaccatgttccatgtgattaacgcctacaccaaggcggcccagtaccctcggctgacggcagagagtggctatcggctgcagcgtgtcggcgggatgatcctggggatggtcaactgagataggaaaagccccatttctggaaagggagtggggcttgatgatagggtggggcagagaagagcagaaagaaattcggtctgtcatgctgtttctccagacccacggggtcagttccacaccccgagcgccgaaaatcccccgtctagttgccagtcttcgcccgacgggagcgaatcccagtcgacatccttagaggacatccggcacgactattgccgtgcatagctcttcctgaacacgataattgcacaggccagttttacaaaggcaatgaaggttgatagatagaggcaatatctcgttcgaataccgcgaaatcctttcagccaagcgaatgtgcgttctacgacccaacgacgagcaggatgaaggccttcttgcttctcaattttctcttaccctcgggagcgaatatgcgcttcaaacccatatgaatacacttcttcatgcacgcgtggataatcataccctttgtccaggcacaagtgatggctgtctgcgcaaacattaaacacatggaaacaagatcgctattatttccgatcgttaagccaactagtcgactgtcgtgaacatttgccccaacgacaataattccgagaggtgtcccttgttggtcaacatgcaaatggatctttgttccagagcgtcctctatctgtgggattcgctccaaggccttcagccgcatcttttttttgtgcgaacaggtgcctgaatcaaagagccgtccatagattgccaggaaagatgaagaccttgctggcgatgataatcttccaggcatattttcatcaattggtcaaagaccccatgtttcgcccctcggcgatagtgatcatgaatagtactttttgatccatagcattttgggatcatattccactgacatcctgttttcaggcggaagatgatgccgttgattatgcttcgagaggatatcggagggcttccgccagaacgctttcgcttaaacggctcaaggagcggttcaaattttgcccataacccgtccggcagttcggtgaaatcatacggcgtactcatgtgcaaaattattaaaggaaattaactagttagtaatatcagtgccggacgtcctcttcgccaggacagcagcttgctgcttggagcccgtaaggtttccctgggccggtaacaatcccagttgcagctaatgatgaacgccttgtgggtcaggcgatcgagcaaggccgctgtcaagggtcgcgtccccaaagaactggggccagtccgcaaagccaagattcgtcgtaatgatgaccgatcctcgctcgtggcgttccgccatgacatggaaaagcagttcagcaccttctttattggttgcgaatgaatatatttataacaatatcatctggctgcaaagtatctggctgctgttgacactaggttcaaggtgccgcaccgtttcgcttgtctcaaatcatcttaagtggcatgatggcaaaataggctacaatcgtgactgttgcgacatcataattttcgagatcttgtgttcacatcaccctcagggagatcgtcctatggccaagaaaaaggccccaccgaagtcaaagcccaagacaggccgagattcttcggtagaaacatctgccacagaccctgtacaggcctctggatcatctttccccataatcgggataggtgcttccgcaggagggctggcggcttttgaggccttcttttctggcatgcctaccgataccgatcctggcatggcctttgtgctggtgcagcatcttgcccctgatcacaagagcatcctcacagatctcattcagcgctatacccgcatgaaggttttcgaagtggtggacgggatggtggtcaagcccaactgcacctacatcatcccgcccaaccgcgacatggccttcatagatggcgcgctccaactgctggagccgtctgctccccgaggtcaacgtctgcctattgacttcttcttccgctccctggcccaagatcaaggtgacaaagccattggcatcgtactctctggcacagggagtgacggcaccctgggaattcgggctatcaaaggtgaagggggcttggttttagtccagaccccagaaacaactgagtatgatggcatgccccgaagcgccattgggactggcctggttgactatgaattgccgccaactgagatgcccagcaagttaatcctctatgtaaaacagatgtatgataatcacggtttgcacaagccgcaccttataattaaaccagataactcattaaaaaagattttcattttgttgcgcggtcaaactagtcacgacttctctcagtacaagccgagcactattcttcggcgcattgaacggcgtatggctgtcaaccacattgaatcaatggaagcatacgtaaaatttttgcaacaaactccatcagaagtggcagcattatttcgtgatctgttgatcggcgtgaccaactttttccgtgatccggaagcgttcaggattcttgaggagcaggtcatccccaaactcttctcgggtaagcctgcgggttccattttgcgagtctggacaccggggtgttccaccggcgaggaagcttattcgctcgccatacttttccaagagcacattgaggcgctaaagcagagctacaaggtgcaactcttcgccacggacattgacagcaacgcgattgctacggcccggaatggcgtttacccgtccacaatcgccgcagacatctcgccggaacgtttgaaccgctttttctcaacagagacaggcgggggcgggttgcgtatccaaaaggtccttcgcgacatgctggtcttttccgagcagaacgtgatcaaagaccccccattctccaaactcgacctcatctgctgccgcaacctactcatctatttgaacggggacttgcaaaagaagctaatccctctcttccactatgccttgaacccgggcggctatcttttcctggggacctctgaaacggtaggcgagttcggcgacctatttgccacactggaccggaaacagaaaatttatcaacgaaaagacgttttcaacgcccagcgtttgccattggcccaattccttccatcaattgcggtgggggatgcaggcgcgcccaaatcaacgggaaaggcatcacccgtcgggaaactgcctcttcgcgagttaactgaacagacactcttgaagcagttcgaccccgtcgccgcccttgtcaacgacaaaggcgtaatcttctatcttcatgggcgttccggcttgtatctggaactcgctcccggtgaagttggtgccgtgaacattttcaagatagcacgcgaagggttgcagcgagaactaaccacagctttgcatagagtagctaagacaaaagagttagtgcagtgtgcaggtctccgcgttaaaactaatggagatttcgctactgtcaatatgaccgttcgccccgtggctatagataatggcgaagaagttgaaacaaacctgtatcttgtcattcttgagcatgttactccagctatggaagcgaagcatgagcatatgactcaggatgcaatatgcccagagacaattgacgatgcgcggagcgacactcatgtagcggcgctcaaacaagaactgcgcaacaaggaagaatatctccagacaactttagaggagctagaaacatcaaacgaagagctaaagtcttctaatgaggagatgcaatctgtcaatgaggagcttcagtcaacaaacgaagagcttgagacttcaaaagaggaattacaatcagtcaatgaagagctggccacggtcaatgccgagcttcagaacaaggttgcggatttgtctcgggctaacaacgacatgaacaatcttctagccggaatgggtgttgccaccgtatttgttgacactcaacttcgcatcctacggttcacccccgccgccactcaaatcataaacttgatttcgagtgatgtcggacgtcctgttcagcatatcgtttccaaccttattggctatgacagtcttgtggtagatgcgcaggccgttttggatactctgaccccaaaagccatcgacgtcgaggcgaaggatggaaagcagtacaatatgcgcatccggccctaccgtacgctcgaaaatatgatagagggcgtggtaatctcattttacgacgtcaccgaattgaagagcgcgcagcatctgctcgccgtggccaatgatcagctccgctacgtgcagcttgggcgtgatgctcgagatgccgtcctgatcatgaattcggatggaaatatcttggcctggaatcacgcggctcacaaagcttacggatgggatgaatccgatgccttgaccatgaacattcgtgacctgatcccggaagaagtacgcgatgcagagacgggaaaattccgagaaatcgctctaggtaaaagtcagggcccacatgcctcggttcgccttgataagagtggaaaacgcataccggtagaatttgcaaccacgcctttggtcgatgagaaaggccggatttacgctatcgcgacactggaacgagttgtctgagggtgaggggtatgaaagacacattgcgccaaagggcggaagagcagactttggcaaatgatgcccagggagaatgtgtctccatgtctcctgaagatgggcgaaaggttctccacgaactgcgcgtgcatcagatcgagcttgagatgcagaacgaggagttacgacggtcccagattgccctaaacactgcaaaggaacgctattttgacctctatgacctagctccggttggttatgtcacgattagcggggggggactcctccttgaaaccaacctaactgcggcgaccatgttcagcactaatcgcagcgacctttttcgaaagccgtttagctcattgatcctcaagcaagaccagtctatctactacaaattgcacaataatctagttgcaacgaacatgccggaggcgcgtgatttgaggatgatgaggtctgacgggtctgaattctgggttcatctgtcggccaccatcggacatgattctgatggacaggcagaaatccacatcgcaataaacgacattaccgaacgtaagcaggctgaagatgcgctgcgtaagagtgaagagcacctccgcattgtctccgacaacgccaccgattgggagtactggcgcggcccagatggaaagctcaagtgggtctcgccctcgtgcaaagaaattaccgaatacacaccagaagagttcatgggggagagccctcttgccatccaacagattgtctatcctgaggaccagggtctatggttggagcacctcaagcagttagacacccaagagcctcctcatcttgaattggaattcagaataatcaaacgatccggtgatgttgtttggatcaatcatatatgtaagcctatatacagcagggaaggtgtgtacctaggacgccgggtctgcaaccgtgacatcacagcacgaaagaccatagagaaggctctgacctttctggcaacctgctgcagtgcccgttcgggggtggcattcttcgagtcgcttgccaggtatttggctgagaccctgggaatggatttcgtttgcattgaccgactggagggggatgggcttaacgccaggaccttggccgtctatttcgatgggcatttcgaagacaacatcacctatgcattgaaagacaccccctgcggggatgtggtgggaaaggagtcctgctgttttccccatgacgtacggggccttttccctaaggacgctgtgctccaaggcatgcaggctgagagctacgtgggcattaccttgtgggattctgccggtcgacccaacgggcttattgcggtcatcggtcgtacccccttgaaggatccctggttggctgaatccattctgcaattggctggagttcgagccggcggggaacttgaacgccttcaggctgaagaggctcttcagtcggcgaaaattgccgctgagtcagccaataaggcgaaatccgtatttcttgccaacatgagccatgagataagaactccgctcaatggtgtgctaggaatgctccaattgctcgacaccacagccccgaatgatgagcagaaagagtacctgctgggagcagttcaatccacaaatcgactggctcggctgctttcggacattctcgacatctcaaggatcgaggcgggtaggatggatatcgttgagttggaattcaacattcagaatacatgggattccatcaaagaacttttcgccctggaggcgaggagaaagggtctcgtcctcgagtttggatgtgttaaagatctcccactattattgatcggagatgaggtgcggctaaggcaaatcctttttaaccttgtcgggaatgccgtcaaattcacagaaaagggaaaaatccggattgatgcctcattgcttccattgctcccaagctcaaaaagttctgccattcgagtattgataactgtacacgacacgggggtcgggatccccgaggaatacattaaagacattttcgagccttttgtccaagctgatggttcatacacccggcgctttcagggggctggtttagggctttccatcgttcgtcgcttggttaatctcttgggtggcgatatagcaattgacagtacattaggtgaagggacgaccgtttatctctctctgccgttgaagattcctgttgctaaacaaaacttgctcgagcttaaagcgaatccggtgattactccatcgctatcctctttgcgcatacttatcgctgaagatgatacagtaagttcactcacctgcaagcggatgcttgagaagacagggtcttcagtcacctccgttaaggatggtaaggaagcgcttcaactcctctgcgagaaagttttcgacttgatcctcatggatatccagatgccagtcatggatggggttgatgccacaagagcgattcgggaaggtagggcaggcgaagacaaggcaagtatcccgatcatcgccatgaccgcctacgccatgacaggtgacaaggaaaagttcctggaggccggtatgaatgattacatttccaagccagtggagatggagacgctcaaggaagttatcgagagggtgatggaaaaggctgtcaccaccaactgaagccagggtgctcactcgcaaactctaccaggatgggtatgattctcgtggtcagtatgaaggacgcttgaaggaaagtcgagacggtgagacagtcaagatttacgatagcaagggatactgccagggacgcataaaagacgataagatctatgattcaaaagggcattatgagggacgcgtaaaagaaagtcgggatggtggcgagtataagatatgcgacagtaagggaaagtaccagggtcgggcgaagaagtattagctgatagtggagcagttagtatgtcatggtatttggttgtggatatacggcattggcttgatgaaaatgaagaaccgggtgtcccccagctaaagagcaaagtcgacttcttgaaggagttgattgcttatgaaactgcatttgaagccggaatggaaaattttcctttgccgatatgtagaaagcggcctgggcgtaagccgtgcaaaagtcctttgaggactatgacggaagataatgtgcagggagttgctgggaaagtgatctattggcaatgcccaaagtgcaaagacagtggtatggtctatggttgggaagggctgatgtgcgacttgtcagggcacgattttgaagaggagagttttaactgagggttgtggtataaggttctctggaaactttcgaaatattggttcgagtgaggttttggatgttgggattgagctgaatgagatgtccctgcaaaaagtccaaaacctagagccttttggagcgtaacgggttgaatttattgatcacgggagcctggttttcgcccgatttcgactttttgcagtgagatcatccattgttctgcttaacgcaaacgatcgattatttagctggcctacacgttatccataagctcaataatttcttttgaaacatcaggaaggctattcaattgctgaaagacactttcgtcctgtgcttccacaatacatggccagccaaatgcctcggatttgcaataagccttgtccaggactgcctcatagttttgttgctttgcgtatgcttcaatgtgcttattcattgcagagtacatttgctcgcgcaattccttttgtctcttttcaatggcaccattcgaagggtgtttcttcttcacccactcctcaagagctgccaaggattttcggcaaactttcgacgactcaaaaataaccctgcggttgaccaagacaatttttttcgcagttatttccggaaatctgcctccctgtggtgccatgtggatattgtcccggggcgttgccgccagggccttgtcaagagcatcgatggcctcctgaccggtagcgccagactcgcctctatgaggaaataaaaagacaacaacaaaaaatgacaggataaaaaaaaccttacgttgcgttgtcgcatccatgaacaccctccagaaagatggcttctggatcagttcgataatttttacgtggctattgcctttgctcagcacttctgacatagtcagagtgaaattagctatttgttgatgtttctaggtccaagctctacagccagatatttttatacagtggtgcttaagattaagtcaagctggtttatacggagagcctcaatgagttgctgacggctcattgcttcggactcgcggtcgatcgtttttgtcgcttccgaagagcctgtcccgggaacattttttagagaaaaatttttccaccatccatcccattatcgaggggaaaagtggctcagaagcccggatatcgacgtagtttattcagggcgtagatattcgcttacgcctagtcattcatgggacaggctccgaagagcctagtttctttgccgtattgcaataggcaaaggtcatgacctgattgggttcaggaccagatcgtggtggcttgtgacgtcgtccaggagtgcaacgacgtcggccaactgtgtcgatggtggaagtggccgaggccaatctctatgagatcggcgaggagccggggtagtttctagccgataccgggtactgtagcgaggacaacctggagtgcatgggtcgaacacggaagcgaggagatcccctggctgcccggtgaaaggcatcacggatcaaaaaacgcacgttctgggaaccagagcggcgatcgttggtctggagagaatccgaggccgggagtatcgctcattgtgaggacaaccttcgtgggacaggctcctctgggatgcacaataaaggggcaatccggagaattccaaccgctctggctggcgttcttctggcgtctgttccccgaggaacaaaatttcttgcttccgggaaccggctagagcccgcccctgagcagccgctccaaagaccggacagttgtgtcggccccagcccgcaaaattacttcccggttcgtacctcaaagccccaggattccttgcgtacaaccttgcttccgcgtatagaattcttcaatcatcaccgcctctgaaacaggctagcccttcaagcgaccccagcaacgggcaaccccatgaaacgttgcaagattcacgcatcactgcatatcctcctggcgtgggacatcaccgtcccattgcggaccaaccgatttatgctcaccgtcttcgtgcttgaagaccaatagcgcaaattgcggactgctgaggcagcagcgtcttatgaaggagcaggagaaatcactcttttagtgaaacattccatccgaacagagtacttcatgatcaagcagcccaatcgacgtcacggaaagttgcatcttcaaatatttacgcccaacaaaatattcctgctatttctcctgattggtgccatcatatccgtcccccccgcacgggcgtctggccaagagacgctgacaaatctcattcacaaagctgcggacaactggcagcagcgcgacttcgatgagatgcttcagtttgtcaaaatcgacgggggcaaggacaccgaggagttcctgcgcgttctcgacacgtcgattcagtccatcaacacgttcaacggcgtctctgccacgcagcaggctcgtgacgccttccgcgcgcgcatcctggaggaacttgacgccagacgcttcgcccaggtggacgacatcctgcgcgaggcgacaaccagattccccaacttggaagccgccgtgcgcacgggttcctccggcctgcgccacctgggcaaggattcggaaggaggctaccggccgctgctgtccgacgacgacatcaccttcgtgggcgaaggcgcgcaggaggccaaaacctggttcaatcagcaggtgaagaatagggggcttgccggtgtgaaggtcaagggcttcaccttgaacgatccgggcaggttctcccgccaggaaagggccatcctcgatctgctcgacccagaaaaatttgtgggccagtccgccatgagcggcatacgcggcgaaaccctgaagaaaggggccgtggtcctagccaagggacccgaggggaagctcgttttcacgcgcgtctcgctggctgaccatctctccagcctcaacgctacgcgatccgccctggattccttcgttgaaaacgccgcgcgacgatacggccccctgaccatgaccgccagcgtggagcgccagatcgtgaatgcccacaacgggtgggacaacctcaccagcgccgaaaaagtcaaatacatgcagcgctcgcgcagaaaactcaacgaaagccggggcctcacctcagatcccgcaacgcgcaggcttgaggagatggcttcgcgtttctcgaaattcccgcccccgaacctgacggctgaggacgccgtgttcctggccacgttgcgccgcgaaaacatcctagaggggtttaaggccgccaacaaccggctgttcatccagtccgtcgccgcccgtcaggcgggtggcaatctggcgaccaatgcacaggtgcgggaagccatcgacgaattggccaccggctttgccatgctcaaggagctcggcggcaagcccgagttcggcgacatggtcgacgtggatgcggtcgtcgacgaactgattcgcaacgccgacggcaatcccgagttgaagaaaatgctctatacggccagcaaacaggccgacgacatgctcgatgtgctcagacaatggagcggcatggagaacgagttcgcggccatgctggcccgcctgccggccatgacgccctatcagcggggcaaggccctggcggaatacaagcagatgctggaagccggtggcgggccgggcatgagcgcccaggcaggcaaaaatgaactggccatggtggaagagctgtccaaagcctccgccaccaaggaaggcgacgccctcatcgtggccatgatcaaaagtccggccggcaagaaggtgctcgtgggcttggcgctcagcggcggagcagtcgccttctccaagatgcaggaacgctggaaggatggcggctggtacaacgatctttcctcggcggcttccaccctggtcgagtttcttccaggggccatgagcttcgaccgtctgcaaaaggacggctatatttcgcccggcctcgcttacgagttcgtcaaggaggccatgtacctcacgcccttgtggccggccgccctatccgctgatcttgcgaccattgcgtacgacgtggcccgtgcggtcacgctggaaaattaccaggacgggcttgtggacatcttggagaccaacggcgtctttgaggacgggcgattcacggcgctgcggctcccagacggcgaaaccatccctcgcgacaggctcgcggccttcctcaaggaagatcgaacggtcaaactcgccaacgccaacaggcccgatctcctctacacgaccaatctctccgagaaggccgccgacgtctacgccagccgctacgtgaaaagcgatccggtcctccaggacctccaaaaggccctcatccaacaaatagggcacatcaacttgggccagactatgggacagatctcggaccaggagtggctggaggccgccaaatccgggttcaagatgctgtttgccgtggaaaacgtctgcaccaagacgccaaagcaatggtgcgaactggtgaccatctaccagaacaaaatcaaggagcgcgccgacgacatctttcccaacgtgatggtcccccacctcgtttcgttggccgaggacgcgcacaaggcgctcacgggcaatgacgaggcgatcaaggcaataatggaaacgcagcgcgagctcgaagcgctgcgaggctctcccctcaccgtggatttggcccaggaagccgcgcaacaggcggccaaggcgggcgacctccgggccacgtccctctccggggacacggcgaccaaacgggacaaggcccttgccgagggcggctacctccaggcggcggccaaggcctacggcgtcatcctcaaggaagccaaagactccctccaggacatcgtggaccgcacgggctacaaggaaacgaaagtccttacgtttccgttctcggggaacttcttccaggatgcggcaaaggcccgccaatcccggcgcggcttcatgttcgccaccaacgccattctacaggacgtagccaagataaaaggcgctgcccctgatgtgcttgacgagaccgacctcaaagccttggagatcctggccgaggtcgcataccgcaaccgcacggccctggaccaggccaactccgccaaggtcgacgtcccggaggcccccgccagcgcgcccatcccggacctccagccgcctatggtaggtaaagagtctccttatcatgcgtggtacaaggatgccatggagaaggtgaaggcgctttacgccaaggctgcggacttgaaaaagctggtttccaagggcgtgttgctcgtcgcaccgggcaaggagatgatcgagcgcgttccgggcgtgttcgaggcccggatcgccgacgcttcccttcgcgccatgctcaatgaaggcaaggcgctcgtggagtggtcctcggatcaatttggcgcggccttctccgacaagacgtcgcttaagacctcttttacccccgacgagccgggacaggccacagtgcgggcgactttcagcctcaaggccgaaccggctgcagaggcgtcggttcaggcaaagatcactgtgcgcccagcggaaacaccttccgtctccctgacggcgcatccgagcgaggcgcagcccaagggcacggttacggcgtccgccttgcccgactccatgtcggcgcgacggccgcttggctacgagtggtcgtgcgacaattgccaagttctggagaagcgcggctcgcaggccctgatcggggctccgagcacgggcgaagcgacggtgcaggtgcgcatgacggccgaggacggcaaggagttggccgccgctgttacgcggttcacggtggccgcgccttccgacaagtccaacgatcctcagaagccagaaaaggaaccaggcggcgtgcctgaaaagcaggacaagaacgctgcgcaggcggctcccgaccaggcttcgaaggaagacaagacgccccgagaccaaaaacttggcccagatgtccagacgaccccgcccgtcgctccgtcgccggttgccgtcccctcggcactcattacgcctgcgccgacaacgcctcctaccagctcgcctgggcagggctcgccaagccaacccgccgggcaatcatcccaggctgcagcccagggccagtctcaaaagcccgaccagtcaccgccgccgcaacaacccaacgagccagcggccgaaaaggctcccgcttcgaccgcgaccgatccggcctggacggcggacacgtggaacgcggccttgacgttgaaatggacctccgagttgcagttggccaaacctggcgtctccgggacggcaaggcaaacatatgaggagcgcaagcaatacgccgaaaagatgctcacggtcttctggcagcgggagaaggagcatctcgccggtttgccggcggtcctgcgccagtggcgtcaggaagcggatggaatatttaacgggcaaatcgactcggaagccaaggatgccgaaaagaaatggcaggaggtgaaacagaagctgggcttgggcaaatcgggccagggcagccggatggaggacgcctttggcgacagcggcaacaaggcctcctacagcagcacgttgcccgatttggagggagaaatgccgaagtccaagcgcatcaccgcctccgaggattttggaccggatatggactgcgcacagaggattcggaaccaacgctcggattacctgggccggctggaccgcaaaatcaccgaagctgatgccttagtggatgcgttttcccggcagccaaccgataacaaaatctatgaagacacgatgcgccgggccgaacagttctgggaaggccccggtggcatgccgccttccaactggcgcgaggcgggcatcaaggagacgcttacccctccctgcggcaaggctccggcccgctcgctttccgtcgccgcgtccggcggcggcaaggcttccagccttcgagtgaccctcaaggcggatgggcagagcgcggccgcaggctcgccgatgaaggtcacggctgaggcttccggcggcaagtcaccgtacaggttcctgttcctggacgcccagtcctcaaaggacaatgtggccgtctacgccctgccggcggggaagtgggagctcttcgcctcggtgcaggtcattgatgccgaaaaccagactgcctcggcggaacttagactggagatggcgccaatcaagctagaattgcacaagaaaagcccttccggcaacagcctcgccgtgggagaacaggccgcgttcgaggcgcgtttgaccagccagggcaaaccggtcgaggccggtcaatacgtcatccgctgggaaccttccacggaggcgcgcttctccaagtcggaggggcttggcgctctcgccaacacggccactttcgcacggcccgggaaggttaaagtctgggccgtggcgctccagaaggcaggctccgtgctcacgacggcggccgagtccaaccagatcgaattggacgtcgccggggcgagcatgtcgctctcggcttctcccgccgaaccattggtgggacaggaggtcaccgtcacggcggtggaaagtccaaagctcgccgacgccgacgcgacctactggtggcacgactcccaggggggcgcgggcacaggtccaacggccaatcagcgcctgtggcggtttacggtcaaagaggccaaacccgtaacggtcaatgccgtgctcaagggcaaaaagggcggtgaggagttggccaaagcctccctaaccatcacgcccaaaatctatgaagtctcagctgttagcctcggacacgcctggggaggcgagacaacccggccggtcatctggaagcctgaagggggctttgtcacgctggacaaggagatcgccgcccacatggacgtgggccttcgcgctgacatttccccggccccgccgcaggggcagacgcttcgctatgcgtggagcgtgaacgagggatcgagtctgaccggagggccagcctcgcaagagacgcgagcgcagcgtgcatccacgggtaccatcgaggccaaagtcgaagtccgagacggcaacaacgtgctgctgggcgctggatcggtaagcgttcccgttacagtgtccgacgaggacgtcaagcagggcaagtccaagtcacaggaactggaaaagctcaagcaggacgccgcaaccgcctggaacgccggggaaatcgacctagcttgcgaaaaggggacggccgccgtccggatcgatcccaaattccccgacgccaagacgtactgcgaaagccgcgagcgtatcctgaatctggccaagcagggcgaaggcgaacttgcccaggacgccctggaacgcgcccaggccaagctcgacgaggccaaacgcatcaacgccaaagccaagatcctggccgggctcgaggagaagatcaagagggccagggaagcgacgtccaaggccgaaaagctgctggcccaagccgccaagcaatgggcggaaggtgatgccgagggcgcggagcgggctgcctccgaggcccttgccctggccccgaaacttgatcgggccaagagcgacaaacagcgctataccgaggggctggccaagctcaaggccagcctggaacacgccaaggatttacagtccaaaaacgagatcgctccggccctgaccgccgtcgccaacggcaagggcgtcaacccggcctacaagcccctgctcgatttggaaaagcaattgctggaacagcaaaaaaagcagcaggagctggccaagcttttggaaaagtcccaaaagcagtgggaagacggcgaggtggacgaggcctgcctgacggcccaggaggccgcgaagctcgacgtgcccggcagcgaggccaaatcggcggccagcctatattgccagggccgcgacgccgtcgcccaggcggtaaaacacggcgagagcgaattgacggccagccaactggataaggcccaggtgcagttggaggccgggcgcaagatcaacgccaaggccaaatccctggccgagctcgaggagaagatcaacaagaccaaggagcggcaaaagcaggttgagcagctattagcccgggccgccaaggagtggtccgacggggaggccgacaaagccgccgcaacggtcgaagaagccctcaagatagatccgaaaaacgacaaggccctggaggaaaagaaatccttctcaggcaagctcgaaaaactccgtttcacggtgggcgaggcgaaaaaggccctgacggccaaggacgccgccaaaggcatggccgccgtggccgagggcaaggcagtcaacgcccgctacaagccgcttctcgacctggaagccgagcttgggaaactctcgcgcgaaaacgcccaaaacgaagccgagcgcaagcgccgcacggacctcatcgtggccggagcaggcgaatgcaccaaggagaactggcaggcctgcaaggacaagatcgcctcctccatcgacggttccgacaagatcttcggcccacaggacagcgagatggtggctaaagccaaggcgttgctggccaaggccgagcagaacctggccaacaagaaacaggccgaagcccaaaacgaagccgagcgcaagcgccgcacggacctcatcgtggccggagcaggcgaatgcaccaaggagaactggcaggcctgcaaggacaagatcgcctcctccatcgacggttccgacaagatcttcggcccacaggacagcgagatggtggctaaagccaaggcgttgctggccaaggccgagcagaacctggccaacaagaaacaggccgaagcccaaaacgaagccgagcgcaagcgccgcacggacctcatcgtggccggagcaggcgaatgcaccaaggagaactggcaggcctgcaaggacaagatcgcctcctccatcgacggttccgacaagatcttcggcccacaggacagcgagatggtggctaaagccaaggcgttgctggccaaggccgagcagaacctggccaacaagaaacaggccgaagcccaaaacgaagccgagcgcaagcgccgcacggacctcatcgtggccggagcaggcgaatgcaccaaggagaactggcaggcctgcaaggacaaactgaccgcggccctggaaggtgctgagaagatatttggtcagcaagacgccgccttgacgaccaaagccaaggcgctcaaggccaaggcccaggagcagttggacgctggcaagcgtcaggccgaggcggaagcaaaacgtaacatggagcaagacaacgccaagaaacaggctgagcagcaacaaaacaagtgcaacaccatgttcaaacaggccgacgccaaatacgaatccaaagattaccaaggatctatcgccatttatcgcaaacttctggaattatgccctgacaattgcaacgccatgaataaccttggcctgtccattgaggcatcaggcaataagcaggaatcgctcaagtggtacgaaaaggcggcaaaatgcgacccatcgcaatcgttgtacgccgaaaatgtcgaacaaatccagaaacagctcgcggagagcaataaagaaaagcagtgcaacgacctatttgagaaggccctgggcaaagacaagaccggcgacagatccggagccatcgccgactacaaagttgtcttggcgtattgcccagactactgcggagcaatgaacaacatcgggatactgcttgacgcttcgaacaacaagaaagatgctttgctttggtttgaaaaggccgtcaaatgcaatccctctgcagagcggtacaagaaaaatgcgactttaacacgcgaagaaattgcgcagcaagagcaaacgaccagcaacaaggcatcctgcgacaagctctgggaccaagctcaagcgaaaggaaaggacgacaaccaccggggcgctatcgaggactatcgcaaggtattgtccatgtgtccaaataattgttccgcgatgaacaatattggagcacaactcgacaaactcggcgaaaagcaaaatgcgttagcatggtttgaaaaagcggcaaaatgcgatcctgacaaggagctctacaaggaaaatgtgcgtacaacacgtcaggaaatatccgaaaatcgccatgaagaacctcaacaaagcgcttcccgccagaacacttcccagccgtcatctcctcaatccaccacggcatccatggatggcacgtatagcgggacattctcctcaccggtctttaaaggcaaagtcaaggttcaggttgagggaaccaaggtgacaggcgtcgccacggactccagcggggcgcaagtggacttcgagggcacactcaaacgacagaccggcgaaatcagttgcttcctcgtttatcggggaaaatcttccgggggccagggaaatgccaagggacatgtgcaaaacggatcgattgagggcacttgggctttcttcactttggaagccaagccaacagaatacaagggcacatggacggccagcaaatagccttacggaaaaacacaacttcacaagtcctgctccagcattgccgaatatggctgctgcaagaaccatcagagtgggtgcacaatcgcttggccatagcaatttttcaccccgcgaggcagatcaagcgcgggagtcggccaagcgtgcaggtccatgaacggacaaatagaatttcagcctgagcatatggaaatttcgcagtgaagactgcgctcggcaaaaactctgaacacacaaaagaggtggacattgaaaacaacaaccttactctttggggtggctctcgtgttcagtcttcactacactacggagccttgtcaggccgatgactcgaccgtccaggcgattcgcgccctggacgtggcaatggaagccaaagccggtgagaacgacccaatttttgaacaagccatgaaggcctatcttaccgaacagtatgaaaaagctctcccaggactgcgtgaggcagctgaacgagggaacgcagtagcccaaaattcgctcgcgaacatgtacagtttcggctacgggacagagaaaaatcaaaccattgccgatgcatggtacgaaaagtccgcagctcagggctattccccagccctaaacaacctcaccacaagcctgctggccagtggcgacgagcaaaagcaggcagagggcctgcgcctgctattgcaattaagcgaccagggaaacgcccccagcgtaaaccgttatgcgcttttactgtcctccggaaagcatgtccccaaggaccctgagaagggacttcatttacttgaaaaacttaccgatgccggtgattctacagcaatgtccattctcggctggagcctgctcaccggagaagacggccgacaagaccaggaaaaaggactggaattactacgacgatctgcccttttgggcaaagcggtagctttttataatcttggcgaggccagtgaaaaaggccttgggcagcccaaagacaacatcgctgcactggtgcaatatcgcatcgccaagcgactgggcaacaagttggcagaaaaacagatcgaagccttaactgcaaccatgagctggcaagatatgctgaccgcacggcgcattttcaattaacagcaacgcatagccacagccccaattggtcgcctgagacgttgcgccgtcaccgcagacaaaatcgcgcagaagctcggctgcgataaaaattcgccattacttgccgaggccggcatcctgtgtgtccttcaccagctttcggatgaagggcatgtcttttatcctcaagacaccttgatcgaaaaggccatcgagattctggaagtggagccaggagttttgtaaccggtcaatcagccccttcttacgccgcttgagctttctgccatggtttatcccacaggaggacgaccatggccacatcagcagcagagggatgttccgaaaaggcgacatattggactgaacatattgcggcttggcacaagagcggcctgagccaaggagcatactgccggcggcatggtctttctcagagttccctgagctattggcggaagcgtttaggggcaacggacgacgtgggcgtcgcgtctttcgtcaccatcgtccccgtgccgctgctcgcatcgactcaagcagacatgttaaccgcacctgaaccgctgctggtacatgtaggtgacgcctttcgtatcgagatcagaggcgacttcgccgcgccggtgttggaaaagcttgtccgcacgctgacacggctatgatgtcgccggtaagcggcgtccgggtttacttggcactgggagccacagacatgcgcaagtccatcgacgggctgtccatcctggtctcacggcagctgcaactcgatccattcgccggtcaccttttcggcttttgcaaccgcagccggaccatcatcaagctgctctactgggatcgcaacggattttgtttgtggcagaagcgcttggagcgccatgcgtttcgctggccgaccagagaggccgaggtgctgaccatcgactcccggcaactcgcctggctgcttgacggtctcgatcccctggccgtgacgggacactcccgcctggagtattcgacgctcttttaggcattattgccttgattaaattgaataatcatgaaagattattcgggccgtggacatcaattccctccctgacgaccctgccgcactgaaagctctcattgtcgacatggctgcggaacatcaggcgcttgagcagcgccttcggctcctgaacctgatcatttacggcccgaagtccgagaaaaagccccgtaccggccaggagcagcagctttccctgttcgatgaggccgagcaggccgtggaggagcacaagccgcagaccttcgaggaggcctgcgccccggcgagcacccgccgcaaacgcggccgtcgccccaaccctgctgatctaccccgggtggagatcatccacgacctgccggaatcggagaaggcctgcccctgcggcgctgagctggtccgcatcggtgaggaagtcagcgaaaagctcgacatcgtgccggccaaaatccaggtcatccgccacatccggccaaaatacgcctgccggacctgcgaaggtgtggaagccgacgggccgacggtgaaaacggcgcccatgccgccccaaatcatcccccagggcatcgtgaccccgggccttttggcccatgtcgccgtggccaagtatgccgacgcgctgcccctgtaccgccaggaggatcagttcgctcgcctggggtgcggatttcggtgaaatcggccacccaattcggaatattcggccacccttgaggggttgagcgcgctggtgttttggtcctgcttcaggtggccgatttggtcaagtccgatgtccgcttccgcatggaatctcccgacagctcgatccggtaggagtcatggacgatcctgtccaagaccgcatccgccagggtcggatcctggaaacgcccatgccattccgccacgggaaactgtgtcgcaaatagcgtggatttgtttcgaaatcgatcatccatcagatcggcgagaccacgtgctatttccgcgctgaccggctccctgagccagtcatctatgacaagcaaatcccgtgtggcgagttttcggacaaggaggcgctgcgatccctcggcccgactgatgttgagttcctggagcagctccgggaaatgaaagtacagacagcgcttcccttcgcggcaggccttttgcgccaaggcgcatgccagataggttttgccgccgccggtcggtccggtgatgaccaggttatgtcttcggccgatccagccgcaggtggccagttcgaggaaaagccttttgtctaagccacgcggggcatggaaatccacgtcctcgactgacgccttaactttgagatgggcttcttgaaagcgcctcgtgagacgacgattgtcgcgtaggaggtattcccggtctacaagcaatccgaaacgttcttcgaaagcccagggaaaccttacggctccaaggaaaagctgctgtcactggctaaggactactcggctgagattcgctcgcgccgggcgaagactggcaaccaggtggtggaattttcggcgctcggggtgggggaattttcggttgtcaaaccgagaaacattgcaaagcaatcaaaacgtccgaagaagtatgtcttgggtctattttgtttgccggtttcaattgtgtttttgctatttgcatgggatatgatagcgaaattagattgatgagcatggtgttgggctatttagaacttcgatgcggaacagcggcgactgtcgaagtatcgtctactcgtggcgtgtgctgggatcgggatgccatatacatgcaattatccggaccactaagggtagacggcatgaggtcgatttcgacgggctggaaacaacgttaaaagttgttctgatcgaagaggttgtagagagaatgttgtgagaagtcgtcgaaagtaaaataggttttcgaagggctgtagctaatattcctggtcgcgccacatgctctgctcaaagcaaagcactttgttgcgcccgccttctttggctttgtacagggccacatcggcaaattttatggccttataaaaggaagcggcgtctgtcgggtattcggcgaaaccgacactgacggttttgtggattgtcgcgccgtttggcagggggaaagcgtggcacttcgacggtctggcgaatcttttccgccaccacggcggtgaagttcgggcgcacttcatggagtagaatgagaaattcctcgccgccaaagcgcaccgccagatcggctgcccgcaccgtctggcgcactaggccggagagttccttgaggaccgcgtctccagccagatgtccgtatttgtcattgacctgcttgaaataatccacatcaaccatgagaaacccgacgcgtttttccgtgcgccgtgagatttcttcgtactgatgcatgtagctgtcgagaaaacggcgattgtgcaggccggtcagcggatcgcgcagggattgttcccgggttatttccaacagattgagcgaagtcagaaccggggcacattctgtcaggtatttctgcatgatggacaatgccaaccgtttgctcgcaaaggctgcgtcctcgatcacaaaggtcattacgccgcccacagccccacccatgaccatgggcagacagcatcggacatgggtagttggatcgacgtggaaaaaggggcatagggccggggtcggttcggaaaagaccggtttgcccaggcgcttggcccggcacagttcagggctggcgaacatctccgaacatagcgcgtcggtggcggcgaaacagttggcagcgacgttggtcgcaagcccgtcggcggcgaactccaggatggcgaactgccctagtcccaggctgcgttggcaggcatcgcctaaaatattgtaaacttcccatcggttataaacgccctggatgtcgtggctaaaagcggtcaggccggccatgtattctagggaagcgctcacttggcccagtgacgacggaccttgcgaggcttccgaagtctgcagcaccccagagaccacctggtccacccggcccataaacccgccccagagacgcacgagggtgttgacagtgtgccgcatctctaccagttcatcaccgcgccgtcgggcatagactggacagagccggcagtgcttatagcggcttaaaaagatacaggtgttgcggctgacggccgaaagagcctcggaccctgtttccagataacagatacgcatggggtcgtgatagaccggacagtctgttttggtgcagtgcaggatgtctaggcaatggacaggcgtggtgtctaagcgtccggtaaagtctccggagacggtgttgccgagaacgcgttcaagatgcgtgagaaacagcttcacccgggccacgttccaataaatgtgaaaccacagcaccatggccccaagcaggaagataaggccgaagaccagggactcacttaccgttgatttgaacaacgccatggagtcgtagccgagaaggatgccgccgatggtgcggccttcgaagtcctccaggggcaggaagcgataaaaggcgttgcctagtcgttcgggtactcctgaattgtccagtgcttcaaggacccggttttcctggggaaggctgaaaccgcgcccgacgatccatttgccgtgaacgccccggatgcggttttggccgagcacggattcaaagcgtttgtcgagcagaagcatcgctccgaaataaggcggcagggccgtcgtctccagcaggttttcaagggaggtggccgcttctactgtgccgatgtgttcgcctgccccatcgtttaagggaatgatggcccgcatggacgcgccgccggggccgacttcgatgccccgaaatggtgatcggtacttgttggctttgaccacgatgggccggatgtccgccaggtcggctccggcggcgtctacgtcccaggtgcgcagaaacgagaccgccggcggcagatgaaaatggaaatagagtgattcgcgtccggtggtggcgcgcaggcgttcggtatagggcaggatgtagcggataaggtggtccttgtcgcgttggcgcatgctctcgatcacttccggcatggcagcgagcggcgagacttcggacaagagtacgtcgaattcgtttgtgatcttgtcttgaatccagtgttggaacacggacaggcgactgtcgacggattcaacgactaccatatcctggtatcgctggaagataaaggccagagtcaagcagccgagtccaagaagagcagcggggacagtcaaaaatcgaagcctgagactccagtttgttggattgaatatgcttgatttcttgagattattaaggaggctggagtcagatgagggccgactgcgggagggggcattggtgcttggggtcggcatcggacagcctcctgccatggggatatcccatgaagatcaatgctgaaaagcatggtttctataagtactttttcaaaacgcgacaatcagatttccaaaactcggctgagactcgtgattgctccccctgatgatggcctgtcccatcgcttcacgtccaatcccacggcaactggattcacagtcaggaaggggatttcagcaggcagtgatatattccgcgccagcacccatctgggtagactaagccacaccccgatccccgccatcacttagagtcttttttgcagatgtatcattgtaccactattttgtgtgtagaactctttctatggcttcaaacagtgctcttttgtctacagattttgcgatatagtcgttcatgcccgctgccaaaaatgattctttgtctccagtcattgcgtatgccgtcatcgcgacgattgggatgctcgacttcgctccaagattgcttgcctttctgattgcttttgtagcttctacaccatccatgataggcatctgaacatccataaggattaaatcgaagtcattttcagtcagtcgctgcagtgcttcctgcccatcattggcggcagtgactgagtagccggatttctcaagcatccgcttgcaggtaagtgaactcaacgaatcgtcctcagcgaggagtatgcgccagggaactcgcttgggagatgaagttccataagggacaagcttcagtggtttctgcttaggtgcaggaatcttgaacggcagcgagaggtagacggtcgttccctcgccaagcgcactatcaattgatatatcgccacccaagaggcttgccaatctccgaacaatggatagccccaagcctgccccctgaaagcgctttgtgtacgagatttcagcctggacaaatggttcaaaaatatatttgagatgttcttcacaaatacctattcccgtgtcacttacagtaagtagcacgcgtacagaagaagtgtttggactcggcaacaaagaggcctcgaccaggacttctcctttgtcggtaaattttatggcgtttccgacaaggttgaaaaggatttgtcgaagccgagcttcgtctccaatcaaagctgtgggcaattcatcgtcccaaatgaaatctaaaacgaggcctttcccctgagcgtccgtgtcaaaaatttcgcgtatagaatcctgcagttgatagatgtcaaattcggtctcaacaacatccattctgcccgcttcaattctagagatatcaagaatatcagagagaagtcgagtcagtcgcttagtggaccgagttgcaccagcaaggtactccttttgttcatcattaggttcagtagtctgaagcaattgaagcatgccgaggattccgttgagaggggtgcgtatttcatggctcatgttggccaaaaactctgacttggctttgttcgcagcttcggcctgcaccttggcactcaacaaatcggcttgagagcgtttgcgttcgttgatgtccacgtgggtgcccaccatcctttttgcgtggccctcggcgtccgtttcaaccacccggccacgtccgagaatccatgaccaatcccccgacttggttcgcatacggaagtcgatctcaaacccttcagaattattaaggctttcggagatagtgtggatggcatgctctacatcatctggatgcaaaaggcctttccacgtgtcaaagtcactggggaattcgccagggtggtagccaagcattgtatagtagcgagggctgaaataggtggtgcctgaagagatatcccagtcccacatgccgtcgtttgcagccattagggccaaggacaggcgttcatcgcttttacgcaaggattcttctgcctgtcggcgttccactacccgccatgtcgcatccatgagcagtgaaagttgaattacatcgctatccatgtagtctgtttgtttgttggccacccccacgacagcgactatgcgtttattgcttaaaatcggaaccgtaaggaagttcgtcagttgggcatggccttcaggatagccctttttcagagggttgtccgtcaggaagtcgttcacgatgattgcacggcactggcgtacagcctcgccccagagccctgtcttagagagtgcgtaacaagattgtggatttgcaatggaacaagcctgcatgacgtcgcgtgaccatgaattgagcgtaaaagattgtgaatcttcgtcgtagtggtaaatgtacccgaaccggctaccggtcagttcaaggcatttgctcagggcaaaatccagcaaggactgggtgtttgccgtgtcgtactggataatctccagcaacttgcgcaaacgggcgtcctcctggcgtagtgcttcttcagccaacttgcggtcggtaatgtcgctgaacatggccaaagagccgtcataccggccagtcgcatcaggcagggacttgaccgagacgagagtccacacagcggtcccgtcgctccgccgcaatctcttctcatagcaatcgtcacagcccctgcgacggtcttccatccttcggaggtgatcctccaggtcctcagggaacagaaaatcctcaatgtttctgcctagcatttgatcctgcgagtatccgaggaggtctgacatgcgctggttcagatagacgatgcggccacattcgtcgctgatgcggatgccttcctgggcggtatcaacgatgcggcggtatcgctgctcgctctcgcgcaatgcatcttctgcccgtttgcgttcggtaatgtccgtgaaaatacagtgggtgcgcatgaaatggccttcactgttcaactgcacccggccattgaaggttacgctgattaaatcgccgtccttgcgcaccatctcgaactctaccccgtcgataacgcaggcctgcttaaacataggaaagttgaggtcgaagtgctctttgaagccaggcgcaagaaaatcgccgaaccacttcccaactacatcgtccttggcggcatagcccagggccaccagccacttccggttcacgtccaggaaccgtccgttttcgtccagggactgataggccagaggcgcattttcaaacaggctacgaaaacgcttctcgctctcgcgcagggattcttcgttacgtatacggtctgtgatgtcgtcgagaatgccaacgacaccagcaggggagccgtctttgccggggaaaaccgcctttgtgaccatcaaggtgcgaaggcccagggcagttggcattacatgctggtagcgctgcatgtcacctaaattcgaaagttcctggtcgcgctgtacgaacacttgcccatgctcctgggggaaagtttctgtggggagcctgccgacaaagtcctgctctggtttccccatgagggtttcaaaggccgggttgacgccgagatagcgaccctggatatccttgtagaacagcggggcgggcatggcccgcatgagcgtctcaacgaagttcaactggccctggtacaaggcttcggccctcttgcgccgcgacacattcagggcaagaaatatcgataagagaagcaggcaaagtccgaccgcacctccagtcaaaaagaggaccttgttgacggcgtaaaaagagacaggggcatttaatatcaccgcgccctcaggcagcaggctctcggacatcccaaaacgtgtgaaggcaagactgtccgcgatagtgacattgttctcctggctgaccacgggaatgtcatccgcccgttcacccttcaggattcgactcgccattgctcccgccgtctccccttgagacctaccggaaaccaccactcctgctgccgggccgtggcccatccagaagtcccatgcgacaaacaaaggaaccgtggaagccctgctaagcctctggctagccgtaggagcggagagcactccattctcatctagggggcgaaccataggtagcacgacccactctggacctagtccagccaagcgagcctcaagcttgtaaatgtccgactcctccaacacctcgatctccacacggcctgaaagtcgtgaggattgtgcctttagaagcgagaggttcgccttgcctgtcggtgtatcctcagcaaggacgagcaacttgctcgccatggggcgtagcttgtttgccaagagtatggtttcgtaaaaggagggtatctccgtcaccccagttatgttcgattgtccgcgcagtatgtccggagagaagttgttgatgccgcaaaacaccacaggcgcattctcggtaattgactttctatgttccagcagaaaatccaaggcggcattgtcagaaactaagaccatgtcaaacggtttgtctgtagatatgttgactatctgctgtttcaacaactcattgtttctacgaaagacattggagtttgttatgcgcgccgcgtctaggtatttaacaaaaacttcaatttggaggccactttgggttagagtagttgagaaagccgcctgaatgtcatctgtccaagataatccctgatggtagctatggattataagtacacgcttgggggtattggaggcctgggtagcctttggcgtggacaagagcatgagcgcacaagctaatggcaggagtatttcgagaaaagcagagcctgcaaagcgtggtacagtgcccatgtctcctccgtaatcggtaaaagtagtcaggtaagtctggcggatagcacagttctcgtgacagtacaaatacaatagtttttaggttggtttgtatcgtctatgccaaggtatatagtaaattatggcaatggtatttgtcattatatctgtggaattcaagttggtagtcgtattctgtgataatcgtaagtattcttgatgtcgcctgtcaaatattctgtgttaattctgatggttgcttagggatgatggtgcataaagggcagttgggcaagtggtttgcgaggccatcctcgtagttctcctgcgagccaagcgtaagcacggcagttggagatccaaattccgccaacacctccgggggtgtagcagggtgggttcaggagatgagggtaggagatgaggatgtgggggacgcttcattcgaaacctgacaagtcattcttcttgccagcctgatgtgcgcttcggggtttggtcggagaagtaaaccgagaagtaaattgaggtgcggatagctcggtatatctcgtcatagctcgttacgaattgcttaggattattgaaaaagtcagcaaaatccgcgtaggggtatggtcctttcacgccggtaacagggggtcaaatccccttggggcaccaggaaattcaaagggcttacagcaaaaactgctgtgtgttcttttcttttcccccacactatcctgtagcggtctagggatccctcaaattttctgccaatatctacacactactccacaagttccctgccggtgagggtagagactgtctcaaggaacaagtctcgctctccttgggcgaactcggcagaaattttggccgatgccatcagcagtcatcagttcaaccgctttaacaaacaacggcacagtcatgctgagagtccgtgaatacagatttgtgtccttcaggggagcccgggtggaccatgccggccagccctccacataaaatcctgaaggaccacaaaataaaacgggcggtcgaagcttggctactgcgtaagggaccgcccgttggcggacgacgagagacaaggacccctggttatttttttttgagagcggccagacggtcacccagggactgcggcggcggggttccagccgcgtccttaagggcctgggcaataagagggtcttcctcttccttggactgggccaggagcttggctttttcctgatggacctgcgcctgcatctccaactcctgagcccgggcggacatggcgtcaaaggccgtgcccatggtgtcggcttgcttcttgatgccggagagcactttggcccgttcttcctgctccttggcgcgctcggcccggatttgggccatgtccatgcggcgcttggcttcggtcaagcgggaacgggccgttttcaggcgttcggaggcggttttgacggcggtgttgagttcgtcgtaatagaatttagcttccttggcctcggcttcctcgcgctccacctcagggaccatcttttccagttccgccaccagtttgcccaggctcgtttcaatcagggttttctgatcgccctcggccgcgtccatctgggcctgcaaccgctcggcggcaccgacgcgcagagtgtatgccttgttaatggcttcggcttcctgctgttccttgtcccaggcggccttagcccccaccatctggcgagtgagcttggtgaggatttcgtcgagttcgccgatctcggcttctgaggcgctttccgggtcgaactccacaatgagtttgagaaatccggcctgggcgtcctcggttttctttacgacgtattgtttgagaaacgacaacataataagctccttgcgttatcttcttttggtgttttggtgccgacgggtcagcagcataagcagggccgccaccgccactccggcacccaaaatccacacccatgatcccattcccgacgtcttgggggcgtcttccctgaccacatgttcagccgccagagccaccgatggatcgacgccgtccatgctcttggggtcaaccggcctcccatctttacgcatctgatcgatcttggcatccatgtcggcgagctgcttcttcaaatcagcattggaagcggccagtttgtcggcttcctggcgaaaagcttggacccccggatcgccctggtggttgtacataaagctcgggccgctggcctgtcgcagcatgaaccacaaaaacatggcatcccacaggccaaacgacggcgcactctggtaggcgtagttcggcgcactccagccctgcccggcgtagtagttgtctctattactgcggtaatcccggtaattgtcccaggtgcgcgagggttgtgggccggcggttccggcgttgtcgcgcaccgggttgtctggcttggcgaacttgcccttgtattcgttgtaggccttgaccgaagcctctttttggacagccgcctgtccggaagtggcaaaggaagatttggatcggccactgtccgtgcccggtgcggcgctggtgcctgaactgttgctccaggtcccgccattcgacggcttggctgcggcgtttggagccgaagtcgtgctcttcggggcgctgttgccccagtccgaagatggagtgcttcctgatttggctgggctggacgtgctttggttggaactgttaccccagccagaagatgaactgctgctgggttgggacggtgcaggagcggtcgaaggcgtggacgaattactccagccagaactcttgccgctggaagacgatgacgatgacgatgacgaggatttgccaccgctggaaaacgacgatttgctgcttttggcctgagccggctggccgccaaggaccagaaccagagccaggaggaggaaaacgatgggccgtgtgctgaggggcatgccggggcctccttaataaaccttgaccccgtagggcgtgagatccaggccgatccaggcccgtacaagggccgcttcaggctctgtgtcggcgcttaccagcatgttctcgttttcgtcccccacctcgcgggtatagaggtgcatctggtgggcaaggcagcgcggcgggtctttcggatctgtaaagagtaattcttccgcttccaccgggggcgcatagtcgccgtccccccattggcgcagataggtctggccgttgggagcattgagatccttgccgccgataagccctccggcatctagccacagaccccaatctgcggcagtagcagggcggatttcttggagcaggcgaaagaagctgacgtcgagcagggcaccggccccgtcctggttgaactggaagagataggtggcctcaccttgtttggcgtaggcccggaccaacttcaggccgaacagcgaggtggacgacagtgcttccaccaacagttcgccctggggcggggcgatggttagtcccaggccctcaaagcgcagggcttcggctacgtccacggccaagatggccccaatgcgcagttcaagggggaaattcggataggcgggatgattgtccgcctttggccgtttgctgaaaaacatgtcctaccctcgggagatggttggtattagcgacggcaaggcggtgctgggctgtcggcggaagcttaggctggcgtcccctgtgaccgcagggaactgagaaacagccccagtccgccgagcagcagcgtcaggataacaagtaggtcgaaaagtgacatgcttgccagggaaaaacggatagaggcaataacacccacgcaaatggccagcagactccccaaaaacagcagccagcccaggatgttacgggcactgtagaaaatcatgacgatgccgaggccaagtggcagaagtgtcatgccggtagtcaggcggaatgagccaaacgtgtaaagtgagtagcccatattgaagaagtgatagacacgaatggagcttaagaataagtagcctcctgcaaccatcatggtcagccccaggaaaaatctccccagccccccaggtgtgccgcctgcgccgttaattgccatacagtccgtttatctaatcgattggccgagggcaagatcacggggggctacggcacgattcttaattaagcttcatacagggattgccgtgctgtggcctggacgacaccgctcgcttccgtgacacgggtcgcccgtgatgccctccgatctgaagcgtgcaggcttttatattgcccttctgatcagtcgctgcgggtttggtcgacctgtctgtcgcgccgccagcattttctaatcccagaatccgaccgttcggaaggtcatcgtccgcttttcacatcttgggcagacatagctgccctgatagagcgtgagcgtcttgcccagggattggatgcgccaaaacgcgaccgcttctgatggatgctcgggcataaggtttggcgatgcgtaggaaataagccctggtggtccgggtgagttttctgtgtccggatattcgaacacgttatacagcgcgatgtcgtgtttggccttgtccaatgcagggaacatgcaaacggtcttgaaatttccccgtccgccgaacaggggtaatgtcttggaatacccgcagggacagctcgcgctgacgatggttccagcatgccctatcgtgccgttgaagcacaaaagtaccacgccaaggagcagacaggccgttgcccgaaaggcgaatgatcgtggggagcattttgcggggaccatgacttcctccatgcgagttcgactttcgtcgaggcagtgggtgtcgatgctgctatttataacctcttgtatgacataggcgatatgcgacgttgcgttagaaaatacttaataatcctaggcattgttatgaattatgccgagagagtgcatttttccatgggccccattgaatttgtgatcccgggttgtcggatgtagcttttggttttcgcgggatttatagttgtgtacttgttgttgcttcttggctatgttagtttatttttgggctgttttcgacgaaaattgcatcttcaagtgtatcgttgttaagatagaaatgtattttgtatgaaacttctcgacttattaccatgttattgctgtctagaaaatcctctttggcccgaatgtcgagggtgttttcagggccagtcgacaattgctgaatggagtgcacgtttaagcctgttttccacacgaacgcttggtcgttgtgctcaatcctaatatagaggagcgcaccattcagagcagggtcgccgccgccgatctcgaagacagtgattaaagcgccttggcgttggattttcgcttgatgcatcgcctgaacggtgtagaggatggagtatctgtcgtcgccagacaaggcagtgcagcgaagagcaagcgcttggctgacgtcggcgaaaatgaatgcaatacccattacaaatgggacaaggaacattcggaaacggttgcatggatccatacgctctccgtcgatattttcggcgacagggcatatccctgtgtctggcgaaacagtatttttcgtggaagcgagcgaccctgggcggccctacagacgcctcgattcgggcgggtagttatttctttgcttcggtttcatgcctcgtgataaaatcattcttgatgtacagccataaaacaacttgaagtgtaacatcaagaggctaacatgttggaactgactcgtcgagttcttttggctctaggcatcgccatgggattgttgctattttttctcgctgatctcacgccattttattccgtgaagatacccaaaccaccttccaagccagttgtccacggtcaggacagtctgttgccgtttccgcgagtgacgtcgcctcccgttgtcattcgagtttcgggagaacaaggagagcgcttcatgtccaaggctctggctgtttccagcggtcaggacatcgaccaggcctggatgcgccgcatcccgccctttgaacggaactgggaaaggccgcgtgaaatctacttcaaggctcccgaattccctttggccgagttggtccatggcatagccgggccagctgacactccaagagtgctggaagatgcctcgggccaacggctcgagttgcgattcacgcgtctggacgacgcttcctttcatctcggttccggtctttcagaatacggtcctccgcttaccctcgtctttgtctggcgtccgtgggcttggtggtgcttcggtgtggggctggcggcataccttgtcttgccctggccacgctacgccaagggctggtcgcatttttctcgttggcgggtctgccttggggatttcggctgggtactcatgtttaccatctttttcgtaatgccgctggccatcgtcgggggaacggtgcaggcggtgacggtttatggtgtctttcccagtatcttctggatattggcaggccttgggctggttctggtgtggtatacggcctgggcgtcctcctttcacgtcggcctgggggagggaggcgtcgccatgggcgctctcggcctggaattggatatcccctatgcctccatcgtcgcggctgcgccggtgcgccaccgctatccgaaatggtttatacgcctgttgtggatcgctgccctgtttggccggggcacggcacgactccaggtcgcggggcaggccatgctgctcggcgcttcgaatgtttccgggctggctttggaactcgacaacggaacgacagcctatctctggctgacggatgcgctgggctccatggccgtcacggacggtgagcggctgatccaggcgttggaagcggcgggcgtgccgttgcgccgcagcccgaaggagctcgtgcggctgtttccgcccatgatgctcgaagccgggagcggcagcgacgtctggcggatatgggcctggggggcggccatttttatggggccgaccgttatagtcctgcttgccatgctggccagggaactggcgggatgaaggtggtgtgatcgaagtttccaaatttctggaagtaagctcccgacagaggggcttgaattcgagtccctcggggactataactctggtacaaagttctggtacaaacagctcccgagatttgtttgagccgacaggaaagtcgaaatatttcagacagatagttctgtaaatatttcgagtccccccttcggcaccatcttgaaggggttgcagcgaaaagctgcaaccccttcttttttgttgcggcaatagcctgcgaaacgctgtcaagcgcgtcgtggccgacgaggccctggaagtccgcacgtcctgaacattggtccggtggccgggccggccggccccgtgaccctgggggctggttgactcgccgccgagcgttgccctgtagcggggcgcattcctctttcgacgaagccaggccgtgcatgacggcttaacgctcgcctctctgaatcaggactcggttgtggccgtgcgtcgcgtggcccggctgtccgcggagaaaggcggcacagccgcctcaaacagatgtttgccgagttaagtctggaaaaccaagccttgaaggatgtgatcgcaaaaaagttataaggccagccgacaaacgcgagttggtcacctacgtccacgtcgagcatgggttgagcttacgccgtgcctgtcgagcttttcgtctgagcaggtctgtgtacggctaccagcccaaggaatccgacgacgaactggtgattgaagcgctcgtcaggctggccgagaagcatccacgatttggcttcggcaagttatttccgttgctgcgtcgcgagcaaccgatgtggaaccacaagcgtgtgctccgggtataccgcgctttgaagctgcatctgcgccgcaaaggcaaaaagcgtctcccttcgaggcatcctgagaaactggccgttccagctacggccaatttgtgctggtcggtggatttcatgagcgatgtccttatgagtggccaacgcttccgtacgttcaacgtgctcgacgacttcaaccgcgaggctctagccatcgaggtggataccacgttgccggctgcaagggtcgttcgggtgctggaacgggtggtggcctggagaggttgtcccgcgaagctgcgcatggataatggaccggaactcgtgtccgtggccctggcggattgggccgaaaaacgaggagtggatctggagttcatccagccaggcaagccaacacagaattcgtacatcgagcggtttaatcgcaccttccgccatgaggtgctggacttctatattttcagcagcttgcgcgaagtccgagagatcgtagaggactggctgaagcaatacaacgaacaacggcctcatgagtcactcggagacctcaccccgtccgagtacctcgccatcaactcgccaggagtctcaactttcgactggcactaagagtgggaggtttacagtgggacatgccccgatttttcggcaacgcaacacgccgaaatcattgacgtgtcccactagtcccatttgtcccgccattttcgaacagttcgcgggaaacacgtaacggggcaatggcgtggattgtaataatatctttttctaatgggactagtgggacaagtgggacaaataccgtttttccaaatggttacggcgtcccaccatgcccgatgtgtcccaccatggccgggacctccgtcccggcaacccgatgcgccggcaaggcgaagctgctcaacaaacaaaacactggtgacagcctaaatgtctgtccctgtgctaacggcccaggtgtttttcctttaactcaattttctactgcggaggtgtgaaatgcattcattttctttaaacaacattaatccgaaagatttgtttgaaaaactttttgctctgcccgccggcacaattttggagatttcgggtgattcacttgttcagctaatggcagcgaaaaaaatgttgtcggccatagcaaaatcggaatacagttgtgaatccttagaagactgcgtttgcatttacctcgatgcagagacaatgaaagttcacctagcgcgtggtatttcggggaatttacgcggcaggtttatcaaccatcctcttcaggggggagatggttcagcaaacctgtaaactcaccttttacctttcgaaggggcttatcgctttttagcagaaccttgtaagctttcatgagttctaaaagcgaagccttttcaattctttcaggcgttatagcctccaaagcgctggcttggatgctattaaggcacaaccctttaatgtcccggaactgcatgggcggccctttgttcaagcggagggccgccatgcgccgggcaatcgtcggcacggaaacgccaagctctttggcaatctccttctggttcttcccactgtccataagaattttaatgtcttctgctgtgatttgccgagcttctttgtgtcccatggctacacccgcaaatttaatatttatcgatcaatataaaaatattatccaattgtttcacggtcaaccctttttgcactatctttgaaagaaattatacagtactcagcaggatcgatatctttgaaatgcgagtcgtctaagttgttgtaacaatttgttacaacagtagcgcctgaaatgggctggcgcgttgctcaggtctaagtgataatttcaaatttgcttcaatgacgcaatgaagtttagctttttacgttttggcaacttctttattcttgcctcaatccttgctgcctcagcccgactttctacctcggcacttgccacaagcctaactggccttcgggaagcagtgtacttagcaccgccagataaagtaccattgtgctcattcagtctacgcgcaatgtcacatgttattccgcaatacaaagtctcgtcgcagcactcgactatatatacaaaccagctcattgttgccgttcaattcaatcgggctgacaaatgtgtatggcgagaaacagtcttattgtttctgacagcaatgccaagagctttcttggttcccacgaggacgacaagctctttcccccgagtgacaccagtgtacagcaaattgcgttgaagcatcacatagtgctgcgtcagcacaggaattacaaccgcagggtactctgacccttgcgacttatgaatcgacacaccgtaagctaaaacaagctcatcaagaccagagaaatcgtaaattatcggcctgccgtcaatgtccacagtcaattcctgctcttcctcgtcaatctttgtgaccctgccaatatccccgttaaagacttcccggtcgtagtcattctttatttgcatgaccttatccccgactcggtaagtgcgcccgccccggactacctctgccccgttggggttcaatgctgcctgaagcgccaaattcagattggtcgtcccgactatccctcggttcatgggcgtcagcacttggacctgattgatggggtcaagcccaaaccgcgccgggattcgctcccggaccaactggatgatcctttgcagtgccctctcaggctcttcttcctcgacgaagtaaaagtcgtcagcatctttgcgggggcgggtgtctggcatgacgcctttgttgatcctgtgggcatttacgataatcgaggattcctgtgcctgccggaaaatttcgttcagttgcactaccgggacggctcccgaagcgatcacgtccttgagcacatttcccgcgccgaccgaaggcaactggtccacgtcaccgaccaggatcaaggtggccggcttgggaatcgccttcagcagatggtgcatcaagatcaagtcgatcatggacgcttcgtccacgacgattagctcgcagtcgaggggatggtcctcgttcttctggaatccgcctttctgcatggaatactcaagcaacctgtggagcgttttagcctcgtgtcccgtggcttcagacatgcgcttcgccgcccggccagtcggggcggccaacaggatatacttggtgatagctgagaagattttcaggatggctcggataattgtcgttttgcccgtccccggtccgccagtgatgaccaggactttgcttgtagcggcggccttcaccgcttccacctgcttctcggctagggtcatggacagcttttcctggacccactccacggccttctcggcgtcaatggagcggacccccttggcagcagcctggagcgccttcagccgcgctgcgacctggttctcggaaaggtggtacttggcaaggtagatggcctctaccggaccgtccggccgatccagcgtctcggcgacaatcttatgctccgtagccagccggccaagagcgtccaccaggactccaggctccacttccaaaatctcgatggccttcacgatcaaggggtcttggggatagaaaacatgcccttcgtccgaaagctggtgcaggacatacaggatgccagcctcggcccggagcggagagtttttgtcgaaaccaagcttctgtgcgattttgtctgctgtgacgaagccgatgccgaaaatgtcatgggccagccggtaggggttctcctggacaacggctatcgactcgttcttgtactgcttgtaaattttcgtcgcgtagcctgagctaaccccgtgggtctggaggaacagcatcacggagcggatttctttctgctcctcccaggcctgcgcaatcatgccaacccgtttggagccgatgcccggaacctcgataagcttctggatgtcagcctcgatgacgtccagggtggcctccccgaacagcttgacgatccttttagccatgaccgggccgatgccctttatcaggcccgaaccaaggtacttttcgattccatgcactgacgcggggacagtggtcttgtagtaggcgagcttaaactgttctccgaacttggggtgattggaccactcccccttcatcttgatgatctcgcccggagtggggcacaagatattgcctacgacggtcaccagttcgcggcggccgtacaccttgaccttggcaatggtgtagccactctcttcactggtgaaagtgaccctctctatttggccactcagatcagaaaattcattttgcgtttcactcatcggcctttaccagcttaagaaaggctccgggatgcttgaacccagtcctaactccctcgctgagggccacatcaaatatgctccttgggatattaagaaccgcaagtggttgtttgtgctcaggcgtgaagtgttgcctagcttccataacaatctcgacaacctcttcgcccagaacaattgttgccgtcgtttcaagcccgtcgaaattaacctcatgccgcctgcccttagtggtacggataatagcatgcatttggcctcctaagtcagggcaagccacacctatgcgggatggtgcctgtgcaaggttgctggcgtgaaaatggccagtgctgattcaaacactttattcgcccgtcttcagggttaaaatccccggctcagtctggcagttttcagttagtggctgagtttttctggacgctatcgcaccgaagcaacgactgtcttttacgcctacaccggggttgagaatagatcgcttggcttgccgtgatgcagctgaactttcagtccgcaggctttaaactcacccgctttagcttgttgttgtttagttggcttgattgaaagcctcattactgttttgatgatgttaaaattttatattttcagttacttgaagttgagatacaggcacctagccggagctcattttccgttctacattgtctctggctgtatcaacaaggaaatatgttctattggttggccgtcccaatttcattggacgtgcctacaacgtcctcgaccatctaacagaaaagccattgaaattttgaaggccttatgtttctaggtagagtatattactagttagtttggaatagttgatcggtgcataaaaatcttggagttcagcttttttgttaaatgttgtacgcatgtaatcgcaggactgcttttttttgacttcacctgtaatgacaccaatttttttgaacacgatggactagtgaggaagaaggtatggttcgtatttatcatgatcgtgcaagtatattgtattaactaaagaaaggtttcggcattctctctccgcaagagggctccctcctttagacagcatggactgccagagtatagggtatgtctgtctaacaatgaaaagaacaaacattactggcgtaaatagtattccgcaaccaagtcgaatgtcatttctaaaacctatatgcaaatgtgatgcaggatgtattcctggattgtgttggtcgggacgatattcatatcgtataggggtgacatgctgttttattccctgttcacaaatgtattgctcatattcagccttaaaagcatctccgtcagattcatatgagcctcctaggttttcaagaaaatttggataagtatcaccagcatacgggcactctaggtatgtaaaacacacataatcatcatccccgtttatcttgttttcaaagcatataagagagttgtcctcaaggtaaaacgtataataatagcgcctatatacttctgtccaatatttttcatagtctaaccccctaaagaatgcgccgggattgcgaggagatgattggttcgggaaatactctttaagcaatccaatctcttttaagaaattgttgcactcattgatttgcggatagaagagtgaatccttcatcgcgacaacctttaatttatttttttgctcaataacaacatccgtattttatcttcgccatattgttcgatcaatttatccatctctttttctgctgctatgtctgaaaatttcttagaatccatgtcatccataatcaacatttctggttcggtgtaagtaaactccattcgaggaaaaatagtttttgcactttccagctctcttctaaacgtattggcagcttcacctattccagttatatacacccagccctttgcgcgagtaagagctgtgaagatcatgtttcggtcgttttttgacgaaaaagggcctgaaacggcatcaacccctaatacataaacagagtatgcttcattgccttttgctttatttattgttgacaaggtaaccattccttcctgttcaaaatcacgtactccgtaggagtcttggtggttgttgtgactcgctatccctagttcgtagagctcagaagccatactggccaaatattcttttgcgtgtcgattgtccaaagtgacgactaaaatatcatcggggcgcaagcctgattcaatgtcttgtttaattctcctggaaacatgttcaacttctaatttaatggtctggaatgctgcacaagacaagatgtcgtcgcgtgtctgagcttctgatactgactttagactgttttcttctggacgggaaatgaccataaaatccccaacttgaaaatttccttgaagcacatcgtagcccatgcttttccagcgctctttggactcaagcatttggacaatttttccaccgctataaatgccaaaccctatagcatgtgcacatacaattatctctctaggatttctatagcatttatacaaaacaatatcgtcttcggaacatttgatatcacttccaacaacatcacgtatggcaggaagagatgtttggaaaatattttgcagctcgtcataagcccatgtagttctattgtcttttgttgactgtgccacaagtttcacgaatgaatttggaaaatcttgtccttcatcgataaaagagtagtcatataaaatttcaggagatggtttttctttaagaaatgcactgcatattttatcaaaagggtttccccccatgtcgcgtgcctggctaagcgtgagcggtgtaatgccatttgcaatacacgcttcataatatacccctggaactgaccgtccgccccatgagtgcattactttaatgccattttcaaagtcgggacttccgtctgaaaattgcctgtagaatcgagtaataagtttctgtacatgttgatacaggctctttgtgtgaaacgtaaaaagaattgtggcattaggattttcaatatgtgttaaagcggccttcattgctaaaattactgtttttcccgagcccgctagcccccgaatcctttggactccttcttttaggatcatgtagccatgacgttgttgacgatcaaattttgttatctcagcttcaagtttgttggcgagatcaccacgcgaaccactggcgacatttcgacgtggctttacccttattaagccattagcaccatctattgttccaataagcctgtcgtatatatcgttgccaatatctgcgttgcctttttttaaagcttcaacaaaaatatgctctgtacgagcgatttctgtttctgttttgggcaagacgcaatcaataacaagatcaggacaatataatattgactcaagattgaataaaagtgtagttctgccagattttagctctttttctttgaccagttttgaataaatatggtcgtatagtgtctctaattgttcaagatcctcgcatattgtagcgcagtcatttctagaatctgacaagccaactaaaaagacgcctcgattctgcgaaataataagaattttagatcttacaatttgaccttcagtggtgttgaatatcggaaagtcgcaaaatacatgggagtcacctaggtttaattcgttttctcgcgtttttaatatgcttcttacgttgtctgcaaggggagactttctgaatgagttttcatcaggaataaaattaagagccatgactgattcctatttatgtttttccaattgaagccaatatgtgtacgccacttgatattagctcttttggtctttggaggctacgcattcaactgctgccgaaagccggtaaacacatgccgtatcatcgtcacaccttcgagcaccaccatgggatcaggagcggaaccatatttcattatctgcttacttctccttcacccctgaatcatttggccattaagccatgcaatgctttgataaatttcgccgaaaagaaaggtattccattcagttcctgaagtgagactggacgccaatatggtcaaagccatggatggcctccggagggggacaagccctgacgaaactaaattcatgcttaagccccgcgcggttatgatccggagaagtgtccggaagttctatagacactcggctaagcggtaaaacgtcccgaacatggaacgcaaacaacaatatagtggtgtcgaagttttactcggagcgctgctcggtttttaccaactccgacgaacacatgacttcttcccagagttcatcatatatgatcgtagacgtttattcgaacatagttcagaaaattataggtgcgtggttgtcaggcttgtcaaatgtcgaatccaggtgcggggcatacgctccacgggttgcccaaggtggtttcaaatactcccctgcgatcgtgttttcaaggctaagggattaatacttataaaaaagccttgttttagcagggatagcatgtccaaactcctgggcaaataaatatccctacgttttgcgtgatataacaggatgttgcgactactgcgtatcttttgttgtccagtgattgtgatctaaaaccattctgagtatcgcaagccactaaatcatacagcaaccccacccccagtggggtctgacgggtgggtgaagaaccccccgccccctccatgcccaggcatcttccgccggtcgtttggtccattcgccattgtagtgtaatatgcaagcagttgttctttgaaaacttgcttgcgtgtttattctaccatttctggctggctcgcttacgggagcaaagccatgaacgcaatgaagtcaaacgccctcacccccgctgaagattcggacattacggattacatcaagagtggcgtcatcgttatcgaaggctacaactatccagttgttcctgacgtactgtctcaggacgtcttcaactcattgcctcccattgccaagcacgccttgctgtatggcttcaagaagaagctggttgatgccgtggccggcaagggtgacgcgaagggctacaccaaggagcgtagggccgaagtgatcgggaaggtttaccgccgactgaccgaggaaaaggtttggaacaagggcgcgttcggagaagtcgggcgcaaggccaagacgattgccgacaaggccctcgacttggggctggagttcactgagcaagagcgggcgtttctggccaagcttgcccaggccgaagaaggacgtaaggcagccgcaaagaaggctaaggccgctgcgaagtagcacaacctacttaaaccttgaacaaagcgagtcagcaagaaatggtggaatgggtaaaaacgacccaacgcatatacgcccattttagccccgttcgggcgcggggtggtgtttggtccgggcgacggggcaaacgtcgattgtgggccattgtggggcgttgtcggggcgtgtcgcccgaaccggatcggcgtggtggccgatagggtcattcccggtcatggcttcatggcggaccgtccgggggcgtggcccaaaagcgcggggcaatggcggggcaaaatcgggaggcaaagaaaaaagggttaggcaaatttgcctaaccctttgaaattcttggtgcgcccggcaggattcgaacctgcgacctacggattcgtagtccggcactctatccagctgagctacgggcgcgccgagaaggaggtatctacggaaagaccccgggaccgtcaacaagtttttgccgcccgctccatttttttccgtttccagggttgaaccgctccccaagggctttgaaatagtaattgtggaaactggttattcgcaaagagccgcgttcaaaggaaagcggctggcgaccttggcccaggcgggccgagaattttgcaaaaaaaagccgccccggcgtgcggagcggctttcaaggccctgagagagtggagcgttactcgctcaccacctcggccttctcgatcaccaccggcacgaccggcacgttctcgtggaagcccttggtcatggtcggcacggccttgatggcgtccaccacttcctggcccgaggtgaccttgccgaaaacggcgtagccccaaccctgggggttcttgccggtgtggtccaaaaagccgttgtcggccacgttgatgaagaactgggccgtggccgaatgcggatcgcccgtgcgggccatggccacggtgtaggccttgtttttgagcccattgtcggcttcgttctggatcggggcgtcggtgcccttttccttcatgttcttgtccatgccgccgccctggaccatgaagccgttgatcacccggtgaaagatcaggccgtcgtagtggccctttttcacgtagttcaggaaattggccgtggtggccggggccttttccttgtccagctcgatgacgatatcgcctttgttggtcgtcaatttgaccacaggattgcctcccttggcccaggcggcggatacgccccccagggttgcggccagaacgcagcacagggcgagaatcgcccgcagccaactcgaacggccttttgaaaccataacgtcgacctcccgaaaaagttttaccgccctatgaaaatttttcaatttcgtcgagcaaaaaaatagtcaccctggacggttgccaattttcgccattcgcgtcaatgattccgacactttttcaccgcgtaaccggccaccgcaaaagcgagtcgaacatgggacgcaatcgtgtcgttgtctatccggactggtgcaagggctgcggcatatgcgccgcgttttgccccaagaaggtctttgccgtgggccaggacggcaaggcccgtgtcgtaaacgaggaagcctgtgtcaactgcggtttttgcgaaccgcattgcccggatttcgccgttctggtcatcccaggcgaaactgaccagacgccgtgtccgtcggaaacggcgcaagacccggccgatcaaaccgccgccaaggaggtcaagccgtgaccgccccccgcaagaaacgccgcgaagcctttctccttggcaacgaggccgtggtggaaggagcgctggccgccggctgcaccttctacgccggctaccccatcacgccttccacggaaatcatggagtgcatggccaagcgcctgccccatgtgcccgacggggccttcattcagatggaggacgaaatcgcctccatgggcgcggtcatcggcgcgtccctggccgggcgcaaggccatgaccgccacctccggcccgggtttttcgctcatgcaggagcagatcggctacgccgccatgaccgagaccccgctggtgctcgtcaacgtcatgcgcggcggggccagcaccggcctgccgacaagccccggccagggcgacgtccagcaggcccgctggggggcgcatggcgaccatcccatcatcgtgctctcggccaccgacgtgcccgagtgcgtggagatgaccgtcgccgcgtttaatttcgccgagaagtaccgcagcccggtcatcctgctcctcgatgaaattaccgcccacacccgggaaaagatcgagctgcccgaacccggcgacttcgaggtgttctcgcgcctgaccccgaccatgccgcccgagtggtacaagccctacgaggagaccatgcgcggcgtgccgcccatgccgcccatcggctcgggctaccgcttccacgtcaccgggctgacccacgatccgctgggcttccccaccagccgccccgaagaggtgcgcgcgctgaccgaacgccagttccgcaagatcgaccgcttctttgaggacatccagatcgtggagcatgtcgatacggccgacgccgaggtggtggtcatcgcctacggctgcgtggcccgttcggccaggctggccgtcaagcaggcccgggaggccggggttcgggccggccttttggtgctcaagaccctgtaccccttcccgcgccgccatgtggagccgatgctgcgcaactgccggctggcggtggtgcccgagcttaacatgggccagctctcccgggaggtcaaacgggtcaacgaaggctacaccaccgtgcgcacgatcaaccgcatcgacgggcagatcattacgccctcccagatcctcaaggagatcgcgtgacatggctgaaataacccaactcatccatcagtacctgcggcacaacaagaagtttccgctggtcttctgtccgggttgcggccacggcatcgtgctcgggtccctggtgcgcagcgtccacgccctgggcctggccaaggacgacgtggtcatcgtggccggcatcggctgctcgggccgcatcgccgcctacgtcgatttcaacaccgtccacaccacccacggccgggcgctcaccgtggccaccggcatcaagatggccaaccccaagctcaccgtcatcgcggtcatgggcgacggcgacgccttttccatcggcggcaaccatctgatccacgccgcccggcgcaacatcggcgtcacggcgcttgtgctcaacaacttcatctacggcatgaccggcggccagtgctcctccaccacccccgaaggggcctattcccatacctgcccccaggggcagctggaaagcgccttcgacatcgtggagctgaccagggcggccggcgcggccggggtgtcccggggcacggtctaccacgtcaaggaactcgacgccctgatggccgaggccatctcgcgcccggggttcaacctcgtcgaggcgctgaccccgtgcttcacccagtacgggcgcggcaacggctttaaaagcgccgtggagatgttcaagtggctcaagtcctcctgtttgccggtggagcgctacgaaaagcttgaggaccgcacgggcaagctccccatcgggaccttcgtgcgccgcgacgtggacggcctggagacgcgctgggcgaacatgcggcaggcccttgccgccaagaagggaggtgcggcatgaccggcgcgcccaaggacaagaccccggccaagcccgccaaggcggccacggccaaggcggctgcggccaaagcggccaacggcaatgggaacggcaacggcaacgggcagaccctggcccgctacgagatccggctgtcaggcctgggcggccagggcatcctgaccatgggcaagctcttgggccaggccctggccatcggccacggctactacgtcacccagacccagagctatggccccgaggcccggggcggggccagccgggccgacctcgtggtcagctccgaacccatcagctaccccaagaccgaatacctcgacctgctcgtggccctgtcccaggaggctgcggccagctattactcgtatttgaagccgcgcggggcgctgcttatcgacgctgatctggtgcgccaaagcccgtccagcgtggccctggccctaccctttacgcgtctggcccgggagaaggtgggcgtgccccaggccaccaacgtggtggcccttggcgcggtggcctatctgctcccttttgcccgcatcgaagccatgcgcaagagccttaaggaatcgctgccggagaagatccgcgaggccaacatcaaggccctcaatctcggctaccaggaggcaaaaaagcgtctgggcgaacctatcgccttgccggacccggacggcggcgacgacatccaggcggcgcgcatggatttgaccgagatcatgaccgaggattagccggcttatcgctcccggggctggcgttttggcgctaaaacgggcaagaaggaacatcgccaaaccccgtcgcgccaacccgcaaggagcctgggccatgctgttgaccgaacacgccggcaaggaactgctggccgaagccgccattgccgtgccccccggcgtcgccctggaaccggacgacgccggggcggccatgccgccttttcccggaccgtatttcctcaaagcccaagtgctcggcggcggccggggcaaggccggcggcgttttgcccgtggccgaggcctcggggctagccgaagcggccaggacccttttttccagcaccttcggcggcgtcaggccgccttttttgcgcctggaggcggccgtgccccatgagcgcgctttctacctgtccctgggcgtctcccggcagcgtaagggcttttgtctcaccatcggccggcagggcggggtggacgtggaagccctggccggcacggacgcgctgctcgtcatcgacgtgccgccaagcctcgtctgtccgccctatgcggcccgggcggcgttttttcatttggggctgcccgccgaggcctatgcgcctttcgagaccttgctgtcccggcttttcggggtcgtggccgacaacggactgctcctggccgagatcaatcccctggcctactgcgccggggagcgtttcgtggccctggacgccaaggtgaccatcgacgacaacgtggccaccttgcgcccggccctggcccgctaccgcgacgaccgcttcgccaccccggccgagggccgcgccgccgaacagcgcctgtccttcgtcagcctgcccggccgggtggggctggtggccaatggcgcgggcctggccatggccaccatggacgccctggaggcggctggactgccggcggccaattttctcgatttcggaggcacagccgacgccgcgcgcctgcgcgtcgcctttgatctccttttcgccgatccggccgtggaggcctgctgcgtcaacatgtacggcggcatcctgtcctgcgccgacgtggccgaggccatggcctgcgccctggacggggatgacgggcggccggtggtggtgcggttcgccggcaacgcggccaaggctggcatggagcgactgcgggccatgcccggaaaccgggtgcgggtggccgaggacatggaccaggccgtggtcatgctggctgaggccgtggacccgggtaaactgcgtccggtggacgccttggccggcgtctgcccgacgccgagggcagggtgcgaaacggcgcggcatcgtggccaagcctgtccccagcgactcccgttgccgagcctgctggaccttggcccggacagcggcgtgctggtgcaagggctgaccggccgggccggacgggcccatgcccgccggatgcgggcctacggcactccggtggtggccggggtgacgccgtttcggggcggcagcgaagtggacggcctgccggtctacgacaccgtggccgaggccatgggccgacacgacatcgcgctgtccgtcatcttcgtgccggccgccggcgcggccgacgccatcgaggaagcggccgccgccggcgtggcgcgcatcgtgtgcatcaccgacggcatcccccagcgcgacatgctgtccgtgcgcgctgccctggccggacggcaaacgacgctggtcggccccaacacgccagggctcatcctgccgggccagtggttctcggccggcatcatgcccaccgaacccttcacgcccggtccggtggcgattttttctcgaagcggcacgctgacctacgaggtggcctcgcggctcacggcggcgggcatcggccaggctctggccgccggcatgggcggcgatccgttcggcggggcgggatttgtggagctgtgcgagatggtgcgcgacgacgcccgggtacgggcggtgatggtcatcggcgaagtgggggggacggccgaggaggaactggccgaatacgtggcaagcacgaaatatcccaagccggtggcggcctttgtggccggcgtaagcgcgccgccgggccgcaccttgggccatgccggggcgctgttggagcgtcctggcggcgtggcggccaaactggcctgcctggcccgggccggcataccggtgtgcgaggaattgggcgaagtggccggggtcatggccgaggcgctatgtcgggggtgagcggggcctgaacctggcgaatcagcccaaaaaagaacgcgcccctaaaggcgcgttcccaagaaatttggcgttcgccagggcgcgaggtcagggcttgaccggcggcgcggcctgctcacccttggcgtcctttttctcgcgcttggggcgcacatatcctttgtacttgtcctcgatcttggtcttttccttggcgaacacggctgcgtcttttgcatgttccttttccacccagctccggtagcgggcttcggccgcgtcggaacgagccgacgaggctggagccggcgcaggcttggccggagcggaggccggcttgtccccggcgggggcggcgggcggttgctgcccaaaggcggccggagcgcataaacaaagcgacagaaccagaaacgccgatgcggcggatatacgcatgtcttctcccgggcggtcataacggggccgcgaattgtgagccggacataatcatattttccctggtccggcaatggtcgccagtaacgcagccccggaaaagcgttggggaaatgaagctttaccctagtcttttgaaccagaatggtctagaatgaagcaatgtgggattctgttgccgcccgcgctgatccggcgcttttcggggccatggccgatgcttccccggacctttttttctacaaagattccgggctggtctatcgctacgtcaaccgttcgttttgtgcgcttttcgacatcgattcctcggaaattctgggtcgcgtcgacgatgacgcctttccccagcccagcgcccgacggcatcgccaggccgatctggccgtgcttgcttcccgccgctcccagacgtttgaatatgttgtcgaacgcggcgaccgttcggtctggctccaagtgctcaaaacaccggtactgggaaccgacggcgcggtggaaggcattttctgcgtcgcccgcaacatcaccgccatcaaggccgccgaagatcaaaaccgtcgcaccgtggccgtactggagcgcgacgccgttgaccgagaagaggagttgcggcgcaccaacgaggaactgcgccgtctggccgctgaacggctcaaggcggaaaaagccctggaagagtcgcaccgaagcctcaattgcatcttcgaaaacagccccattggcattgcctttgtcacggaccgtatcgtacgccgggccaacccccgcttccatcagctctatgccctggagccaggccaggcggttggcttgccgacggcggatttttatcccgatgccgaagcctacgaggcctttggccgggaatactatccggcgctgggggctggcgagcgggtggatgtggttcgcgtcatgcgacgccatgacggcacggagttctggtgccgcatcatcggccaggtgctggatgccgcccggccccaggacggttccatctggcttatggaagacgtcaccgagcgccggctggccgaggaggcgaccctggccgccgagcgcctcaagcgcgaattcatggacaacatgtcccacgaaatacgcacgcccctaaacggcatcctgggcatggccgaggtgctgtcggccgggcttaccgacccgcagcagcgcgagatgcttgagactctcaaagactccgggcgctccctggcggccttgctggaaaacgtcctggatttcgcccggctcgacgccggggacgtggtcagccggcgcgcggcgttttccctggtcaatctgatcgagggcgtggccgcttcctttgccggcgcggccatgcaaaaaggcctgcatctgtcctggcgcgcccagccgtcaacgccggaactcgtggtcggcgacggcggcggcttgcgtcagattctggccgccctggtcagcaacgccgtcaagttcaccgacgccggcgccatcgaaatcgtggccgaggcccggcttccccaggccgcgtcccgtgacggccaggcaacggttttggtgagtctggccgtgcacgacaccggcatcggcctggctcccgagcagataagcgccattttcgcgccgtttcgccaggtggacggcagcaagaccagacgccatggcggcgcgggcctgggcttggccattgccggcaagctggccgccgccatgggcggcgaacttgcagtggacagcgaaccgggccggggcagcgtgtttcgttttaccgcgcctttcgaagtccagacgactaccgactcctaaccaccactgcttatcgctaacgcgccggttggtttcccctggtcccgggggagcgacgggccacgtcctttttacaagacgagctgggtgggctgacccgggccggcgctggcgaccagccccggcggcggttccagggcgagcaggggggcgacgtcggccggggccgagcggagcgggtcgagccagtcggccatggctgccgacgggacaatgagcggcatgcggtcgtggaccgaagccgccgccccaaccgccggccgggtgaggatggcgacggtgtccttgacctcgccggcggcggtgacggcccgctcgtagagcgcgcccagggccagcaccggccggcccgggatgctcaggaaaaatctggtcttgcgtccaccggcgtcgccgcgccattcgaaatagccgctggccgggaccagacagcggcggtagcggacggcggcgcgaaaggacggcaaggtcagggccgtctcgccgcgggcgttgatcatgggccgggatttggccgaatcagccaagaaaaccggcacaaatccccatcgaaacagtccggccatgcgccggcccgattcccgggccgtgaacacggcttcgatgagctgggaaggatagatttccggccggggcgggacatcaggcaagtccggcacgcccagggcttcggccacgagccgtcgcggcacggccagggcgaatcgtccgcacatgggatttcctccgttttgggtccgggttttgctaggcctggggagtaaagtggaccccaacgccaggaaatacggctgatgtttcaaatcgcatgttatttcaatggaatgcatgtctcggcctgggccaggcctgatcagggcgcggtgtttgatgctgcatttgtaacaaagtcaaacccatgatatcgccacccccgccgctcccgtctcccggtgatccggactgcgagtaccagcccattcccgtgggccaccttttcccccatgcgccgggggatttccaggtctttttgcgccatggcgacaatcataccctgtttgccagggtcggcgagacggtcaccgggctgcgtcgtgaaatgcttgccgattacggcgtgcgcacggtctacatccaccgcgacgagcgggaccgctaccgggactacatgcgccgccatctgcccggggcgcttttggggccgcatctgcccatcgccgaaaaggccgccattttctaccacaattgctgcgacatcgtgcgcgacctcatccgcgagcgtcttccccaggccgtttccgacgtccatggccggctgtttgtcggctatgcccgggacagcgtggcctttttgtgctccgaggccggcttggcccgcatgggggcgctgatggcccatgattacgatgtctacagccacggcgtgcatgtctttgtgtacacggtctatctgctgcgcgccctgggcttgccccagggggccattgtccaggccggagtgggggcgctgctccatgacgccggcaaggaaggcgtggacccggccattttgaccaagcccggccggctttcccgggaggagttcgacgccgtgcgcgagcatccggtccttggggcgcggctttgccgcagccttgggctgtcgcgtctggcccaggagtgcattctcatgcatcacgaaaaactcgacggccgaggctatccggctgggctttccggcgaggccatcccggtgcacgcccgggccgtgtccctggccgatgtctacgacgccctgacctcccggcgctgctacgccgacgcggtcacgcccttcgaggccctgcgcatcatgcgtcatgagatggccggctctttcgatctcgacctctacaagcggtttgtcatgttgctcagcggcgcggccctggtctgagtcttgcttccggcaggagacctcggtaccgtcgtgggatactcgccgagattcttgccgcctgcggccccaaccttgttgggacacgggacgccatcgggcgaggctgtccggggaaacccggccgccgcaaaaggagcgttccatgcccaccatcacgccccgtatcgccacggtgctgccgcagtccggcaaacgctttcattggctgttggccgcgttgctgttccagattgtggcctcgccttttgtcgtcggcgcggcttcgctgatcctgcaggatttcctgtttctggccatcctgctggcggcgcttggagccgtcaaccatacgccgttgcgccggttcaacagcctgttggcgttgatttgctccgctgcggtcgtcttgaaatacagtttcccggattggtatctggatgtggcggtcagcctgcttggggccatggtcatcctgtccacggccgtggagatggtcaactacctgtcgcggcagcgccgggtggatctggatacggtgcttggcggactgtgcgtctaccttttcatgggcgcgctctggctcatcctctatacgttggctgtgcagttcgatcccctggccttcgacttcacggttcacggccggaatttgtcgcttcgccatcgcgacagcctgctgctgtttttcagctacgtgacgcttttgaccaccggatacggcgacgtggtgccgatttcccccatggcccgcaccttggccatcctggaaggcatttgcggccagttttacctggtctttttcatggcccggctggtggggctgcatgtggccgaaaagggcggggcggccccttcctcgtcccattccgaggaaggctaatgccgttgacgcccgctccctggcctctctccggcaaggattgactaggcctaaaacgccgccaatatccccaccacagcacccgtggacagcgaggccagcacgccgccaataagcgcccggccgcccagggccgtgatctcggccttgcgcgacgggcagatggccgtcatgccggcgagcaaaatccccaccgacccgcaattggcgaagctgcacatggcgtaggtcaggatcagccgggcgtgttcggaaagggcttccggcggcagcttggccatgtcgataaaggcgatgaattcgttgagtacgattttggtgcccaaaagcgagccggccgtggccgcctcggcccaaggcacgccgatgagccaggcggccggggccatggccacgccgagcatccgctccagggtcagcggcgtgccggcgacgcctggcagcgcgccgagcaggatgttggccagtttcaccagggccacgaaaaccagcagcgtggcgatgatgctccaaaagagcttgagcccgtcggccgtgcccgaaaccacggcgtccatgctgcccgaggccggggacttgggtatcttgcggccaagggtcggttccttggtttccggcagcatgaggccggcgattaacagcgccgccggggcatggatgaccgaggcggtgaggatatgacccagggcgtcggggatgatgccttttaacactgttgcgtagagcatgagcatggtgccggcgatgcaggacatgcccgtggccatcatggcgaagagttcgctgcgggtgatgcgctccatgtaggggcggatgagaagcggcgcttcgatcatgccgaggaagatgcagcccccggccccaacgcccagcacgccgccgatgcccatggcccgttcgagaatcaacgaaaagccccgcaccacatggggcaggacacgccaatagtagagcagcgaggccagggcggcgatgacgatgaccagcggcagggcctggaaccccaggatgaaggccgagcccgggtcggtgacggcatagggggccgggccgccgcccacaaagccaaagacgaaggccgtgccggcccgtgtggcttcgtccatggccgccaccacggcgttgagcgccatgaacacgccacgcaagaacggggccttgagcatgagggcggccagcacgaactgcaaggccagcccaccgacacacatgcgccagggaatcacgccccggcgttcgcttataaggccggcgacaagcaagatgacgcaaaggccgagcaaaggctgcaacatggcggtttcctgggaggcggcggtttagaacatgctccagagcatccgggtggccatggccagcaggaacacggcaaaaaagcgcttaagcgtcgataccggcagcttgtgggccagtttcgcgccgtaaggggcggtcagcacgctcaccgcggccacgccgacaagggccggcagatagatgtagccaaaggacagggacggcagattcggcgcgccaaagccgttgatgatgtagccgatggttccggccagggcgatggggaagccgatggccgccgaggtgcccacggccgtgtgcatggccacgttgcaccagaccataaacggcaccgacatggtgccgccgccgatgccgaccaggcttgacaccgcgccgatggccagcccggccccgaacatgccgagcttgcccggaatctggcggtgggccttgggcttgatgttgagcagcatctggatggagacgtagtagaggaaggccacgaaaaagcccttgagaaagcccgtggacagcttggccgccacgcaggagcccaaaaaggtgccgaccaggatgcccggggtgatggccttgacgatgggccacaccaccgcgccccggcgatggtgggcgcgaaggctcgataccgaggtgaacatgatggcggccagggacgtgcccagagccatctgcatgatgagttcctgggagaacccctgggcggtaaaaaaccagaacagggccgggaccacgacaatgccgccgcccaccccgagcagaccggcgatgatgccggcgaaagcgccgaagacaagataggccagcagaaacgacagtgacggcatggcaggctccttaagggaaggaataagggctgcctgtaacggaatatgccgtcattgaaaagggttgtgaaagctcagggcaaggaaaaaccccggccgccacgggaaagcggccggggaaaagcaaaagcggtctaggcgatgccgtagccgctgatgtgcttcatgtattcgtcgacctcgtgggccaggtgattgaacagcttgttgacgccgttgtccggctccgagccgatcttggcgaagacgttgccggccttggcgtaggcctcttcgaaagcgtcgtccccgagtccggacatttccttggcctcttccttggtcagatgaccggtatggacgaaataggcgcaaacaacggcgttgactttccggatgggttcttttttgggcatgagcggactccttgtgaaagcgggcgtaaagttatgcctgtgaaactacggcatttgcgcccggaaatgcaaggccctggcgcaaaaaaagccagcggtcgccgcagggtcgcggtctaacccgccggacaccggtcggccaggggcttgatgtcgatcacgggcgtgccgtccagggcctccagggcgtcgatggtcagcacgttgcccgcaacggcggtcaggcgcacctggtgcaggccgatggggttgggccggtccggagagcgggtggaaaacacgccggtcaggggccgggagcggtcgcggcggggatgcacggcctggcaggagcggtcggcctggtggaaccaggtgaaaagcaggatttcctggcccggggtcagatccttggccgccttggcgtaggccgggtccaggacgaccgtggccggcggggcgttttccgtctcgaacttgggagcggtggccttgtcggtcagtacggaacgcaccacgccgacggcgtaaagggtcatatccattggaagcctcctttatcctgcggcctcagctcctttgggtggagccgacatagatgccggctagggccagggccacgccggccagttcgaccgggccggtgggtttggcgaaaaagagcacgtcccagacataggacagggtgggctggagcaggagcaccagcccggccagggccggccgggccccggccagaccgtgggaaatggacagccagccgatgccctggccgatgacgccaaggcccacaagcgcccagacgctaacggtcgtgggcagggccagggagtcgccgccaaggacggccaccgggccgagcagggcggctccggccagggacagcacggccatggccgccatggggccggcccggccctggtcggtgacggcctttttgagcgtcaggatgaaaagcccgtagaacacggccgtggccaggccgtagcccacgcccaggcgaaattccggggtctggccggcaaagccccggccgaccacgaggtacagcccggccacggccacggccatgccggccaggaagcccggctttgggacgcgtcgggccgtgacggcggccacgatggtgacgagaaacacctggaaattgccgaccagggtggccagccccgggccgatgtaattgatgctggcgtgccagcacagcagatcggcgctgaaaaacacggcgcaggccaaggccggccaagccagggcgcggcgggcggcggccaggttgccggtggcggcgagcagcccaagcagggtcaggccgccaaagcacatgcggtaaaaggccgatacggccggcggcacgccggccagcttcacgaatacggccgagaagctgatgatgaccgcgccgaaaaggagttgtcccatggcgcgctagccgaaatggtcgaagccgcgctcgtttatgggggcgccgttgagcgtgtagccgggcttggccgcgatagccccgatgggcttggcggcaggcacggcggcgcgcagggcggccagggcggacggcgcgaccgtggccagcagggcgtagtcctcgccgccgaaaaaggcgaccttttcgggtggccggccatggccggcggcgtgggccgtgacttccgggtgcaggccccccggcgggaaaaagaggtcggccccgtggccgtccggcaacaggcgcggcagatcccgggccaggccgtcggagacgtccatgcaggaggtgacgccgggcagcgcggccagggccagcccttcggccaggcgcggcacgggggccaggtgggcggcggtggccgccggccagtcggccagagcggcgcggccgtgcttttccagcaccgccagccccacccgggccagccccagatcgcccacggccacgaggatgtcgcctggatggccggctccccgggtgagaaagcgcccggacggcccgggtgcgccccagaccgtgacggacacggcgattttgtcgccgcgcgacagatcgcccccgaccaggggcacgtcgtggctggcggccagggcggccatgccggccaaaaaagcgtcccagtagtcgcggtcggcgtcgtcgggacacacgatccccaggacaaagcccgtgggtgtgccgcccatggcggccacgtcgctcaagttgacggccagggacttggccccgacctcagccggggtgaagtacgagcgccgaaaatgcacgtcctcgacaaagaggtcggaggtgacgcacaggcgcgccggcacggcgaccacggcggcgtcatcgccgcgcggcagctccacgccagcggcctggcgagggaagtgggcatccatgagggacagaaagtcgtcttcggaagcgatgcggggcatgggcggaaattccttgcagccggggacgggcggccgcccccggtggaacggcgaaggtgggagggcggctacttcagggggccgaaagcggcggcgtagcggtcggcaaactcctgccaggtgaaggcgtgttcctgggtgccgtgcttttccacggcataggcggccgataccgagccgagacgggcggcgacatccaggggcttgtccagggccaggcccttgacgaagccggcgcggaaggcgtcgcccgcgccggtggggtccttgacctcggccacggggcagggcgggatggcgatttcggaacccttctggcggatgaccgagcctttctcgcccagggtggtgatgacggtcccggcgcgctccacgatctcggcctgggtgagcttggtggaattctggatgagttccagctcgtagtcgttggaaatgaggtaggtcgcgccggtgagcatctcggcgagctgatcgccgctaaaggcggtgatgttctggccgggatcgaccatgcaggggatgcccttggccttgtagcggcgggggaagtcctgcatgtcctcaagattgcccggggcgacgatggcgatggtctgggccgggtcggcttcgtccacggtatagtcggcccggtgcttcatggccccgggattaaacccggtgatctggttgtcggccttgtcggtggtgatgtaggccccggccgtgaattcgccgttgacccggcggatgccgtcgatggcgatgccgcaatggcgcagccaggcctcgtaggcggcgaagtccttgccggcggtggccacgatggtcgggtcttcacccaaaaggcgcaggcaataggcgatgttgccggccgtgccgccgaatttttcctccaggccttcgaccaggaagcagacgtttaggatatggatcttgtcgggcaggatgtggtcggcgaagctgcccggaaagctcatgatgcggtcataggccagggagcccgagacgaggatgcgcatggggcgtgtctccttcatgcggggttgtcggtttggggcgtggtttcgtcttcgatccagcgcaggaaatcgggcagcccgtcggtgatgggcagggtgaccacgcagggcacctcgtagggatgcagttccttgacccgggcgatgagcgccggggccagggactgccgggtcttggccacgagcacggcctcgtcggctttttcgatggcccctttccagcggtagacggaacgcatcgccgggaaaatattggcgcaggcggccaggcgttcctcgaccagggcggccccgatgcggtcggcttcctcgacgctcggggcggtgacgtaggcgaagacggcggtcatggcggctcctgtggcgtgatcgcggcggggtggccgacaaggggcgcgacccttgttcgcgtcaacgaaaagcgcagaggacgtttcgtaaataacagcctaaaaccatttgttattcttgaaaaacaccttcgtgttttttaaggggcgcgacgctaagtccgggtcggaatgccgtggatgcgcaggtagcggtacaggctctgcttgccaagctcggacagttcgcaggcccggtggatgtcgccgccggcggtctgcatgaggagcttgaaataacggtgctccacatcctttttgtattcgtcgaagggggtgagcaccagttcctgggcggctccgccggcttcggcaacgggaagcatctcgacgtcctggaccgtggccggggtgtccttgacccgcccgctcatgatgcggatgcggatttccggcggcagatgcttgggatacagtgtgggctcgtactgggcgcgcacgatgatgttttccatgaggttgaccagctcgcgcacgttgcccggccagtcgtattcttcgaggctgtccaggaattccggggaaaaacccttgagcggcactttgtacttcgtgcaaaaggcgttcatgtaatggatggccaggccccggatgtcctcgccgcgaagccgcagggccggaatgttgatgtgcatggtgcgcaggcgaaagagcagatcgttgcggaattcgccggccgcgaccagggcttcgaggtccttgttggtggcggcgaccaggcggaaatcgctggtttcctcttccttggcccccaccggccggaagcggtgctcctggagcacgcgcaaaaaggccttttgctgggaaaagggcagctcacccacttcatcaaggaaaagcgtccctttgtcggcctgcttgatgaggccttcctgttttttttccgctccggtaaaggcccccttggcatggccaaagagcaccgattcaatgagcgtttcggtgaggctggagcaatcgaccaccacgaagggcccgtcggcccgttcgctgttgtcgtggatggcccgggcaaacagttccttgccggtgccggtctcgccggtaatgagcgtgttggcgtcggagttggcggcctgggccaccagatcgaggcaactggccacgcgcgggctgccgccgatgatgccctcgcgcttgagggccacggtgggcgggcgatgggcgaatttttccttgcggtactgcagggcgcgaatgagcggcagggtcatggactcggccgtggccggcttttcgatgtagtcccaagccccgtttttgatggccagttccgcgccgttggggtagctcgcgccggtgaaaatgatgacttccggggcgcgttcgcgctcggtgatcttggggatggcgataagcccgttgccgtcgggcagatcgacgtcgagatagaggacgtcgtaaaattcgcggtccagggcgtcgaggcccttggccaggttgggcatggcggtcacctcatggcccatgccttcgatgaccagcttgcagacttcgcgaatgtgcgtgtcgtcgtcgatgacgagaatcttggccatgcctcctccctgtgtcggcaaacgataaagctgtaaagccaagcggcggttttgtcgagacgggcgcgcgtccgggaggatttgacggctggttaagaggttgcgtacattgccgccaagcaaggaggcggacatggccgagacggaaaacacggtcgaggagacgatgccggggcgcaagcgtccggtgctcgtctggatcatctttctcttttatctcatcagcagcgtccaggtcatcgtggccatgtttttcgtggccgccggcggcgtggacatggccccggagcagcaggcctatctggccaagttctcggtcctggaccgggtcatcggctacgtcaacgccgggttgacgctggttggcgtgtccatgctcttgtcgctcaaaaagcaggccgtcaacgtgctggccctggcttttgccctcaatctcttttccacggccgtggtctggatacgcaccgatccggcggcggtgacgagcgtgaaagggcttctcgcccaggggttgggcatcggcatgttcgggctggtggtgctgtatgcctggcggttattgaagcgggggacgctggcgtaataagttgaggtgcaataggagtattgttcttgtcttaattagtgtttattccgtttgtcttttttggagagctggggttgcaagttttttttgtaaattaatttcaataaaatagcagcgtactgaattatagtcgctattcagtgcgctgctaagctgatacttgttgttttagtttgttagtaggggatatttttctttaaagagcaataagaagccgatccatatttcgttgaatcgctctgtgtatatttttatggtttttgagaagtcgttttttctagcgtaataagcgtttatagttggttcatatattccgatttgggatgttgattcgggggttaataggcaatgtttgtagctattgtgtaggtcgtttattgtcttgaggagatttctttcgttctcagtgagcttgagagtgtcgtttgcaaaagggtgttcctcgtcatgtataaaatctccgagttcactaacgtctagttgtagtgtttggctgaatttttgaaaattattcttgatataaagtaattgaatcagtgcattcatgagctgcttcatgaggaaaattgttatttctatggttattatatgttttgtgacaaggtctttgtaggcaattggattagttggtgtgttcagcatttgttgcatttcagaaaaagtgcgttgtacctcatctgcctgatggtttaactccttggcaatagatgcaattctgggctgaattaaaagtggattaaagaagccatcaatagcaggaatagcaggtataaactgagtatgaaataagtcagggagtctttcttcgactgaaatgcgctcaggagctttgtaaggcgggatttctttggtctttagattcataatttccccttttttccaagaatatacataactatatacgtgctgtcaattttcccatgtgtaaatttattctcataatatcggataaattctcgatacttcccggggctgcccacgcgttttgacggcgtgtgggtgaccccggccccttgcaggctccgtagcatctcccggacatcggcgtggaccacggtgtggcgcgccgttgtcatctcccagacgatccccggcatggcggccagcgtctcgcgccaccagtgctccggccgcatggggtagaccgagccgaagcccgtggcccgggaggcctcgtccagctccgacagcgtcccctccaggtaaaaggccagggcgaagcggccgcccggccgcagcagccgcagattggcggccagcgaccgggccggatcggcgtaccagtgcatggccgaggccgaggccaggaaatcgaagctgccgggcctaagcggagccgcttcgccattggccgccagccggaccaccccgggcggcatggtggcatgggccagcatcccgggcgagaggtccagggccacatagaggctgtccgactggccggcggccaaaaggcgcggggcgagccggcgggtaagcaggccgctgccggccccgatctccagcacccggccggtgagatgctcggggcagcggccggccagttcctcggccacccgggcctggaccacggccacgctctcgtagccggccccggcccggtcgaaacggcggcggatgtcgcggctgctcatgaccacagaagcccttgcaagagttccgggcgcggccagtggccgccggggtggacgctgtgggccgctccgggcagggcggccaggactttctccacggccgaggcccgcacgatgcggtcggccgcgccggaaacgaccgtcacatggccggcggcgacgtcgggcgcggccgcttcggaggccagcagatagtccaggcctgccgtgagcgccccggtccaggccggatcgtaggccggcggcgcgtccacggcgcagttttgccagaaggcggcgatggctgccgccggatcggccttcatgccggcggccatggcccgcacggcgcgggccggatagcaatcagcgaagcgcaaaaatggcgcgagaagcacaacccgtccatagcgcgggaaaagggccgcggcgtgcttgaggatgatgtgcgcgcccgtggaccagccggccaggacgtcgccgccgtccatgagccgcccgaccacaaaggcctcgtcgccgtccagaaacggcgcgacaaaacgcgtgcggcccgaaaggcccggaaacagcgcctcgggaccggcaaagccggagcagaaaaccgtttgcgtcatgggaaaaaggaaacccgaagcctggaaaacccgaggcggatgtgtttgaggtcgtcgtcggtgaggtcggctcgcagcgacaatcgcagccgggctgtgccctggggcacggtgggcggccgtacggcggccacgagcaggccctcggcccgaagcagggcctgggcatggagcgcgacacggtttctgccgcaaaaaaccgggatgatctgggtagtcgaacccatggtgtcaaacccaaggctgtccagatggtcgcgaatctgccgggagatgcgcatgagccgcgccccaagcccgggattggccttgacgtggcgcagggcggccagccctgccgccagcacggccgggggcagggccgtggaaaagataaacgagcggcccttgttgcgcaaaagctcaatggtctccacccgggcggccacgtagccaccaagggaccccaacgccttgctcatggtgcctacctggacgtccacgtcgttggacagcccaagcgccgccaccagcccgcgcccccggccgagcacgcccatggcgtgggcttcgtccaccacgacaagcgccccgtgggctttgccaagctcgaccaatcgcgctaagggggccacgtcgccgtccatgctgaaaaccgtgtccgtgacgatgatctttttttcggccaaagcttcgcggtcaagcagccgggagagatgctccatgtcgaggtgcttgtagcgcacgagccgcgccccggagagcaggatgccgtcgatgatgctggcgtggtttaagcgatcggagaaaacgaccgtatggcggtcggccagggacgtgaacacggccaagttggcggcgtagccgctgccggtcaccagggccgcttcctggtatttgaaggtggccaattccgcttccagggtttcggccagggcgaagttgccggtaatgagccgcgaggctccggacgaacagccgtggcgcgtggcggccttgttggacgcttcgatgaggtccgggtggtgggacaggcctaggtagttattggaggcgaggttaagtagcttcgcgccggagtagacaacctcccgggccgcgccgtcgtccacgggcggaatggtccggtagctgtccgaattgcggagtttcgccgcttcgggcacaatgtatttgccgaaaaaggatgtgctcatgtctcacgtttccgggaaggcggccatgcggatctggcacccatgcacccagatgaaggaccacgagaagcatcctcccgtctttatcgaccggggtcaagggatttacctctatgaccgccagggaaagtcctatatcgacgccatttcctcgtggtgggtcaacctctttgggcatgccaacccgcgcatagccaaggccgtcaccgagcagctcacgcgcctggagcacgtgattttcgccggctgcacccacgccccggccgaggaactggccgagcggctgctggccgtggtccccgaaggcctcacgcgcgtctttttcgccgacaacggctcctgcgccgtggaagcggcgctcaagatgagccacgcctactggcgcaacctcgggcgtcccgagaagtgcaaattcatctatctgtccaacggctatcacggcgaaacggccggagccttgggcgtgtgcggcgaccggctctatgccgcgccgtttacgccccttgtcgtgccgcagatcgaagtggtcggcccggaatgtcacgcctgtccgttgggacttgcccgcgaaagctgcgccgccgagtgtttcggcggcatggaagcggccatcaaggcccacgcggacgagttgtccggcgtcatcatcgaaccgctggtgcagtgcgccgggagcttccggatgcatccgccggcctatctggccaagttgcgccaggcgaccaccgccgccggctgccacctcattgccgacgagatcgccgtgggatttgggcgcacgggaaccatgttcgcctgccagcaggcggccatcactcccgattttatgtgcctgtccaagggcatcaccagcggcacgttgccgctttcggtggtgctgaccggcgacgccgtgttcgacgccttctaccacgactaccacgacgacaaggcctttttgcacagccacagctacaccggcaatccgctggcctgcgccgctgcctgcgagaccctgcgcattttcgaggaagacgacgtcatcattgccaaccggcccaagatcacccatctgcaagccgccgtgcgccagcgtttcgccgggcacaagcacgtgtccgacatccgctccacgggctggatcacggccgtgtccctggccgccgatccggccgccggccggccctttgacgaacgcgaccgcacgggatttcgcatctaccgcgaagccatcaagcgcggcgcgtggttgcgaaacctcggcgacatgatctattttatgccgccctacgtgatcacgctggaagaaatcgacaggctgaccgacatcgccctggatgcggtcgaggcggtgcttggatgaagcgctattatattaccggaaccggaaccggcatcggcaagacggtgttctcggcccttttcgccaaggaacttatgagccagggcctgcgggtacgctacgtcaagcccgtggccacgggctatcccgaggacgacgacgcggcctgggtggccgggcaggccgggctaggggcgggcgaggcgctcacgctctacacggcggccgagccggcctcaccgtgtttcgtgttcgatccctttccctttgcgcagtgcgtggcgcgcatcgaggcggcggccgagggctgcgacgcgcttttggtggaaagcgccggcggcctggccgtgcccctggggcagcggcgctataattaccatttcgccctggaactcgggctggagacgattctggtcgtccccaaccgcctggggtgcctgtccgacgccatcgtctacggccatttcgccaaacggcacaagctggcgttgacggccatcgccgtaaacgaccatttcgcggccagcccccgcgagggggaccgcaatgcggcggttattgccggagagtatcccagccagacgatctatcgttacgacacggcgttgtcgatgctggcgtaacggcgcgacgcccgggaagctcgccgctttccgggcgtcgcaccgacctgccttccgccccctcgatcctggcgagcggcatcactcttcctcttcaggcccgcccccgtccaccagttcccagcggatggcgctgaccgcgctttccaggctcagacgcgagacggcctgctccagcacccggtcgcagtcgctttcgcaggaaacctgggctcggacctccaccttgcgcgggtcgtcctgatcctcgctgtgcagtgagcgcagcttcacggccgagctgttgaggatttgcagcaacagcgtgcggatgtgctgctcgctctcgcaggtgcataccaccacaatatagtagcgcacggcctcggtccggcgcgtcggacagcggttgaccacgttggccagggggcgcagcaggatgttggccagcaaaatggccgccgcgcccaggccggcgaaaaggtacgcgcctgagccggacaagaccccgacagccgccgcgcaccacaaggtggcggcggtgttgaggccccggatggtcaggccttcgcgcatgatgacgccggcccccagaaagccgatgccggagaccacctgggcggccatgcgggtggggctggcgtcctggtccgccagggcggtgagcgccacgaaaagggccgcgccgaccgccaccagggcgttggtgcgaagcccggccatgcgctgtcgccactggcgttccaggccgatggccgcgcccagaaccagggccgcgccaatgcgcagcaggaattcgaaatccgtcatgttgcactcctccaaatagaaaacgcccggggaaacggctggttccccgggcgtcgcaaggacgggaaatctcccgttcacgtcatccctgggccagcatctccatggcctcgtccacgctcttgccgtcatgcacgatggccgtgacggctttcagcaactcggccgggtccggggcctggaaaatgttgcggccaaccgacaggcccgcaccgccggcggccaggctgtcggcgatcatggtcaaaaagccgcgtgtggagtcggtcttggggccgccggcgatgaccaccggcacgcagcagccgcccaccaccttggcgaagctgtccgggtcgccggtgtagggcaccttgacgatgtccgcgccaagttcgttgccgacccgggcgcagtgggccaccacgtcggcgtcgaactcgttggaaatcttggggccgcgggcgtacatcatggccagcaccgggatgccccaggacacggccgcctcggtgacgcggcccatgtcgtcgagcatcctggattcggcggcgtcgccgagattgacgtggaccgacacggcgtcggcgcccaggcgcatggcttcctccacggtgcacaccagggtcttggcgttgggaaagggagacaggctggtgctggccgaaaggtggatgataaggcccacgtcgcggccgcgcgcccggtggccgcagcgcacaacacccttgtgcatgagcacggcgttggccccgccggccacgatgttggtgacggcgtcgcgcatgtcggcgatgccctcaatgggaccgacggagacgccgtgatccagcggcacgatgatggtgcggccggtgtcgcggttgacgatgcgttccagacgaatggatttgccgatggtcatggtcgatctccttggcggtttttcgcctgggacccggccccggtcggctcatgaaaaaagggccgccgggcaatctgcccgcggcccttgtcggcggtgttttcgggagcggcctttagtcggccgcgccacccgccaagccgcgagcgcgaaggccgtaataataatacggtccgaaggaaacggtgcgcagggcggtctgacgagcgttcatggcggtataagtgccccaatccggccggcccgtcaagagccggagtaaccggacggcggcaggatttctggcggggccggggcgaccaagccctcgttcaagatccgttgggcatcttcctgggggtcggctccgggcgtcatgatgttgttgccggagatgcccggggcgacctgccagcccttttgccagtggccggactggctcgggtagtagcgggcggcgtcgcagcggccctggcaggccgggcaggattggttgcaccactgggacggcgagaagtcggcggcctggccggtgtcgatgacgcagacctcgcggccggcggcatccacgcaggtaaacagtccgtaggcctgggcctgtccggtcagacagcagacaaaggcggcaatggccagcaaacgcgtacacaaaagcatggctccctcctccttggcctttcggcgcagccccggctgccccaaagaaccctatgtcgccgcgtcaccactccccttacccttaactggggggtccgggggcctcaggcccccggccgccggaggcatcttcctctttttcttgcttttcttgttacgtcaaccgttcgatgtccgcgccgacgttttgcagtttcacttccatggcttcgtagccccggtcgaggtggtagacgcgctggatgagcgtctcgcccttggcggccaggccggccagcaccagcgaggcgctggcccgcagatcggaagccatgaccggcgcgccggtgagcgtgccgacgccccggataaaggcggtctgggacgagatgcggatctgcgcgcccaggcgcaccagttcctggacgtgcatgaagcggttttcgaaaatggtttcgcggatggagcttgagcccacggccacgcacataagggccatgatttgcgcctgcacgtcggtggggaagcccgggtagacctgggtggccacgtcgacgcccacgagctgaccctggcggcgcacggccacgccggcgttggtggcttcgatgaccacgcccatttcgcgcagtttggagaccaccgcgtcgagttccatgaacgggcagcattccaggtgcagctcgccgccggtgatggcggcggcgatcatgtaggtggcggcctcgatgcggtcgggcatgacggaatagcggccaccgccgaggcttgggacaccttcaatggtgatgaccgaggtgccgtggccggtaattttcgcgcccatggcgttgaggaagtcggccagatcggccacttcgggttcgcgggcggcgttttcgaggatggtggtgccttcggccaggctggcggccatgagcaggttttccgtgccgccgacggtggggaagtcgaagacgatgtgcgcgccggtgagccggtcgcagcggccttcgatgtagccggcctccagggtgaaggtagcgcccattttttccagcgccgtgaggtgcaggttgacgggccgcgcgccgatggcgcagccgccgggcagggccacccgggcgcggccggtgcgggcgagcagggggccaaggaccagcaccgaggcgcgcatggtgcgcacgaggtcgtagggggcctcgggattgaggttcgcggccggctccatggtcacggtgttgccttcaaaggtcgaagggcagccgaggatttcgttgagcttgagtgtggtatggatgtcgcgcaggcgcgggacgttatcgacgacggttttttcggtcagaagcggcgcggccagcagaatgggcagggcggcgtttttcgagccgctgacccggatggggccgttaaggggcttgccgccccgaatgagcagtttatccatgaacgaggtccttggggggttggtgggatgcggcgagaaacgacgggccgcccgagagaagacgatagcgcggcgggtccttttgggcaagagaaggaaaaaactgttgacaccgggccgggggttgggtagataacttctccttcgtccatggtggctgtagctcagttggtagagtcccaggttgtggccctggttgtcgtgggttcgagccccatcagtcaccccagcaattttccttgaaaaggcccggttaactaccgggcctttttgttttttcgggccagcgcagcggcgagacaaacaaaagccccggacgggccggggcttttgttgtcgggagcgggaataagggccgctagcgcagcaccttcttgaccacggccaggagctggtccggggtgaagggtttgacgatccagcccgtggccccggcggacttgccttcggcctttttgccggcctgggattccgtggtcagcatgaccaccggaatgaatttgtaggcggcctgggcccggatgcccttgatcaggccaatgccgtcaagattgggcatgttgagatcggtgatcaccatgtcgatcgtgccggacatcttggaaagcgcgtccttgccgtccgaggcttcgatgacgtcgtagccttcctttttgagcgtcatggcgaccatctgtctgacgctggccgaatcgtccacggtcatgatgcgtttggccatcttaatcctcgtcggagaagaagtttgcgagtttgggcgtgcgggcaaaacccgaaacgcgcgcggcggccagggcagccggggaaatcgtcccgtggcgacgaaggctcccgccgttttgctccagggtgagggccgtcgccaacagcagttgcaagaaggtgatgtcggcttcctcgaccccggaaacgtcgagggtcagcacgttctgttcggacacggccttaagcagcgattgccgcaaggtggccgcatgttctaccgtgcatttgccggccacggcgtagatgggcttgccgccttgttccaatcgggtcagttccatgggcgctcctcgtaaacccggctactgcgacactgtacgaaacggttcgccggtgtgcaagcggctgtcttcccgaccgcgcacgaaacgcacgagctggggcacgtcgaggatcaacgagatgctgccgtcgccgttgatggtggtgccggaaatccacttgaggtgacggtaacagtcgtcgaggcttttgatgacagcctgctgccggccgatgaccttgtccacgcaaaagccgacggtttcgccttcggcctcggtgatgaccacccgctcgtaaccgggctggtcgccgggcacgtcaaagagccggcgcaggctgaccaccggggccatggaccccatgcgttcgatggtgtccacggtgcggacctgcccttccacgaaccgctcctggaaaccgcgcaggttggccaggggcacgatgaaggagtcgccgccgaccatgacgttgaatccgtcgatgatggccagggtgagcggcaagcgaatggtcacggtggcaccctgaccaaggacgcttgccagttccaccgtgccgcgcagggcctcgatgttctttttgaccacatccatgcccacgccccggccggacacgtcggagaccttggcggccgtggaaaagcccggggcgaagatgcagtccaaaagctccttttccgagggttcggcctcgggcgcgacgagtccgcgctccacggccttgcggcgcacggcggccacgtcgatgccccggccgtcgtcggcgatgacgatgaccacgttgccgccggaatggttggcggacagggtcacccggccctggggggacttgccggcggcctggcgttcctcggggcgttccaggccgtggtcgaggctgttgcgcagcaggtggaccagcgggtccttgatgcggtcgatgacggtcttgtcgagttcggtttcgccgccgtgggccacgaattccacgtccttgccgaggttggcggccagatcgcgggtcaggcgcgtgaactggctgaagaccgagccgatgggcaacatgcgaaggccaagagccacgtcgcgcaggttgtcggtgaggcgttcgagatcctcgtcgacttcggtgacggcgtcgaggtcccgggccttggccgcctggcgcaaccgcgattgcaggatgaccagttcgccgaccatgctgaccaagctgtcgaggcgggcagcgtccacccgcaaggtggcggcggccgccggggccttggcctggggcgcggcgcgcggttcggagcctttcttggtctggcttttctgcttggcgctttcgataagggccagcttcgcggccagggccgcctccagtcgattgcctgcaacctccaggtcttcgtcgtcatggcccttgagggcggccaggagttcgtcgaggtcggcggcccgcaggatgccggtatgcagatgatggatgccgacctcggagtcgccttcgacaaagatgaacacgtcgcgcaggttatccacggcgcaaggcgtggcgatgagcatgtcgaacaggccgtagacacgctcggggtcgaaatcgtcgttgtccaggaccggcttgggaccgtggcgcagcacgtgcatctcgcccattgtgtcgagttcggccaaaagccgcaccggatcgttgccggtgagcagcatgtccgggttggggcgtagacggacccagtagatgctcggcggcccgggcagggccgggcaggcgtattcgtgttctcccgaggccggccgcaggatgggcggctctccggcgtcgcccgcaaggtccggggcggtcgccgcgcctccgggcagataggcggcaaaggaggccagaaggcggtccgaggcgttgcggtgggcgtcctgctggtcgcggggggcttcgagcagggtcaggatgtgatccttggcggccagggtgagactgagcagttcccggctgacgggcagatcgccggtgcgcacccggtccagtacggtttccacgtcatgggtgaagcgggagatttcttcgaagccgaacatggctccgccgcccttgatggtgtgcatggcccggaaacaggcgtccagccgggccgtgtcggcgggattggtttcgagttcgagcagaccttgttcgagttcgccgagcagttcccgggtttcttcaatgtagagagcaatggacggatcaacgtcgggcatgtcgggcctccctgtcgccggtggtaaactctctggccggggcgggcctagaagcgttcgaactgctcatcatcgccttccatgtcgatgctcaaggccgtggccttgttttttcccgacacgggtgcggtcggcagccgccgaggcggtctggccgctgccctgggaacggctttggctccggggggaggggaagtcggacgtagcgagccgtcaagccggaagtagctgatgctggcctgaagctgctcggcctgggccgagagttcctcggaagtggaggccagttcctcggaggccgaggcgttttgctggatcacttggtcaagttgctgcagggccttgttgacctgggaggaaccggtggactgttcctggctggcggcgttgatttcctgaacgagatcggcggtgcgctggatgtcgggaacgagcttgccgagcagttcgccggcgcgttcggccacggacgtggaagagcgggaaagccgagtgatttccgaagcggcggtctggctgcgctcggcaagcttgcggacctcggcagcgaccacggcgaagccgcggccgtgttcgccggcccgggccgcctccacggcggcgtttaacgccagcaggtcggtttgccgggcgatttcctcaatgatggagatcttgccggcaatgtccttcatggcggccacggcctgggccacagcctggccggattcgcgggcgtccccggcggccttgacggcgatggcctcggtttgccgggcgttgtcggcgttctggctgatgctggaggtcatctcctccatggccgacgaggactcctccacggccgacgcctgttcggtggccccctgggacagggattcggccgaggcgctcatctcctcgctgcccgaagccacgttctcggctccagactgcacttcgctcaccacgtcccgcagccgttcaatcatttcctgcatgccgcgcagcagcacatccttgtccgagcgcggcgtgaccgccacgctcaggtcgccttcagcgaggctggcggctaccccggcggccatgcgttcggcctcgatcatgcgctgcatggagacgagcagcgcgccgatttcgtcatggctgtcgatggtcacggccacgttgaggtccccatgggccacggcgtcggccacggtgatggctccccgcacgccgcgcaggatggcccgggtgatgaagacggcgaagatgacgcccagcagcacagcggcggccgaagcgccgagactgagcaggttggccgttcgggcttccgcggtcatggcggttttttgggcgtcgacggcttgatcggcgagctgaccggccttgtcggcggcggcggccatgtccttgaccacgacggcctgggagtcggcggcctggagaaaaccgtccatgcgtgttttatagacgtcggccttggcggtgatttcggccaagagggttcggtctccggcgtcgctcataagctgcgaggcatcccgcgctgcggcgatgagtttgtcgagcagggtgcgggcggtgtccatccgggttttgtcgccgcgccagaggtagtaaagcacctcaatgcgggcgcgaagaaactgttgttcgatgttctcgatgcgaagacgcaaggcagccgtccgggcggcgttttcagcgctggagtcggcgattttcttttgctggtcctcttggcggccgagcagttcctcggtgactttttgcagggcattggcggcttcgactacggtctttagcgtatcgtccctggttttctcgccttctaggtagcgggaaaggccgctttcataggccgttgccgccgtgacgagattgtccatcagttccacgttgcggggatcgctcaaggatcgcctgagcgtttgcgcctggtccttggccagtccgaggtgcttgcgaaacgcatcgagcctggcgttgtccttggactgcatgaagtagagcatgtccatgcgggcgttgagcacattgtcgctgatggagttgacggcatccattttatcgacgcgggacatcagatcgaccaggcccttgtacccaatgccggccacgatgagcgtgagacagatgagcaggccaaacccggtgccaagtttgaaagccaagccacggttcttaaacatatccgctcccgctgtgaaaaactcgcgcctgcccgggccggacacggcgcccttgttcaaacgctgcctgtaacgcaacgaagtcttctagcggaaaaagtcctcgtcggaggcgggcgtcgcctgttggaccggcggcgggacgtcgtcgcccaagacccgggaaaggtcgtgtatctcgtcgctggaaaacaccttgtccacatcaagaacgaggagaaaccggtcaccgtgtttgccgatgccccgaatgaagtcggcccgcacggccgcgcccatgcggggcggcggatcaatgcggtcggtttccagttcaagcacttccttgaccgagtcggccagggcgcccatgacggacagggcgtcgtcttttttgatttccacgatgacgatgcgggtgttgagcgtgcgctccacctgtcccaggccgaatttcatacgcagatcgaccacgggcacggcgctgccgcgcacgttgaccacgccacgcatgtattccggcgtctggggaatgcgggtgatgtccgtgtagtcaaggatttccctgacggaaaagatgtcgatggcgaaaagctcattgccaagggtcagcgtcaaaaaacgctggctgccgtactgggcgtcctgggccatgggatgctcccttgtatcgcggcttaacgggcgttttgtgggacaaaaaggtccactaccttctagcctactcgtaattcggcagaatgacaacgccttttttacttttcttgagcgcaacgccctctttttgcaaggagcgggcagccgccctggtcgggactgctcctgatggcggcactccacttttccgtttttttcctttatagtaacggaaaagggagaggacgccatgccgccgaaaaacgccaccgccgccgccgtaggcaagaccctggcagatcgccgtgaacaggcccgagaagccgccctcaaggaactgcgggcgctgcgtggcgacctcaacacccttgaggccgtgctcaccggcaaacgcaagaaatctgatttttcgccgttcgacgtggtgcatggcgctttcgaaattttccgccacgccgcctcggtcttcgaggccgaagacatgctggccgcctgcgcccgggagctcgaagcggccaaggctcaagactatctccagcgccatggggccaacgacctggtcaagccggccggctggcactggatttccccgcgcggggaaatgcattttctcggcaagtccgacgacgccgacaaggctgcggccaagctggccgagctgctccaggccggtcgccggcccaagcgcaaggacaaggccgacggccagactgaggccgaacccgctgctccgatcccggctcagatcgaagcgtaatggatacgtccggcgacaccagcatgacgtggctgcgacgttttggcgcggcggggttactggtcctggccctggccggctgctccgaggaacctgccggcgaagtcgagcgcggcccggccggcaagaccccggtggtgcgccccgaggatgtccacggccagggagccggccgggccgccgccgtcctggccccggattaccgccaggacatgaagccgggcgtcaccgacccgccggccgcagccaaggcccccgccgaacccgccggccgtcttttcgcggccaagcccggccagcccgcggctgcaccgcccgcggctgcaccgcccgcggctgcaccgcccgccgcgccaggtcagcctccggccatctcgactttcccggtccagcccccggccgtcccggcgggaggcgcccagtccgcgccgtcgcccgtgctcatcaccccaacgcccgccggcccgacgccggccgccgtggtcaccgccgctcctgcggccgttgccccttcgcctgccgctgcaccagctgtcgccgcgcagtccgccgccatgccccaggctgtccagacgccccagcccggcccgggccagcggccctcgaccggtttcccggtggaggaggcccgccagctcctgctggtcacagccgccgacgcccaggccgacaagggcacgctgcggcggtatacccgcaccggcccgggcgcgccctgggtcgaggccggccagccggtcccctgccgcctgggccgcaagggtctgggccagggccgtggtctggctatggcgctctccggcggaccggccaagcgcgaaggcgacggccgcacgccggccggcgtgttcccgattccggccgcctttggctacgcctcggccgaggacgcggccaaggccggcgtgcgcttgccctatgtggcaataagcgaccggacatcgtgcgtcaccgatgccggttcgccgcttttcggcaaggtggtggggccgggtgagcggcccgagggcggggtgcgccaggatcgcatggtgcgcgacgacggggccaatgcctggggcgtggtcatcggccacaatgccggcgcggccgatccccaggccggaacatgcatttttctcaacgtgcgtccggccggcgggccggccaccggtggcagcgtgggcatcccggccgaggccgccgccgccctggccgcttggctcgatccggcggccaggcccgtggtggcggttctgcccgaggccgaggccaaggcctggggcctgccctgagcgtcgtgcgcggctggcgaatgacggcgggccgggtaacatggggcgagggcgctcgccacgcgtcgcgtccacgaaacgggtctcttggcgtttcgcggacaacacgcaaaccataggagtcctcaataacggccttcgtctccatgaacaggcccgaccctaggcccggcctcgggacaggatgcgctcgatgacggcggtggtggatagccccggaaccaggggcaggctgacgacccggccgccccgggccgccaccgcctcgccgccgacgatggacgccaccggccagtcgccgcccttgaccaggacatcaggcgcaacggccaggatgagttcaagcggcgtgtcttccgcaaaaagcgacacgtagtccacgcaagccagcgatgccaggacataggcccgctgggcctcgggcgtcaccggccggcttgcccccttgagccgggccaccgaggcgtcgtcgttaagccccaccacgagcaggtcgcccagggcccgggctcgggccaggagatcggcgtggccggcgtggagcaggtcgaagcagccgttggtgaaaaccacggtgcgccccggccgcgccttggcgatggcggcagccagggcgtagcggtcaaggatcttgtcgtgctcaaatgtcatggcgcttgcggcgaaggcgttcctgacgaccgaaaaagaccagctccagccagtccaggccgaattccaacgcggcttcctcatcggccatgatccgggcctgccgctcggcatcgatttccaccagattgaagatgcccatcttcccgataaggtcccggaactcgtcgggcaggtactgggccagccagaccatctggatctgcttgggggacaagcccacgcccttgccgcgcgtgagcgccatgaggaacatgtagcggtcgttgaagcggttgtagacggccagatcctggtcggtcagccactgggccgagctccagtcgcgcgattcctcgaagccccggcagtgcggctcctggacgatgaagaactgttcgatgacgccgccgtcgtcgtcgagcttggtggcccggcccaggggataggtgcggcaggctccgggacggtcgccgtagaccttgcagccctcgggcgagacaaaggggcagcgtttggcccgctcctcgcgcatcttgaggtgcagcatgggaaagccggtgtccggggcttcgaagcggcgggcgaagtggttcatgaagtcgaccgggctgacgccaagggcccggcgcagccgcaaggcgtcgtagggcgtgagcatgagcgtcaggtccgagcagcaggcgttgaagcagggcacttcgggatggcaggcgaagcggaaggtttcgtcggccgtgagctcgggcagggatttgagaaacgcctcggtggcgtcggcctcgttttcggccagggcgtcgtttaagtctttcatggcggctatgctccttggccgatgcctttagccccgggcggcgtcccttggcaaccgccgtggcggctcgccttgacagggcgttgaaaaacgggaagcttcccctaattggtcgtacgcccgagggcgcggcctgatgtttttcatgctgtcggacgggactgatggcccgttttgcggccaatcacgcgcgcaacgccccgcagcaagggacgcggcgcgccggggacaggatgctgccgggtttttccttgcgcatagccaaccgcctgctggaactagaccgcgtggccgacgccgtggaagccttcggcgaggcccatggcctctccgccaagctgcgctaccagctccgtctggttctggacgaactgctcaccaacaccatctcttatggctatgccgatgacggggaacacggcatccatgtgggcatggccgaggagggcgggcggctgcgttttctcctggaagacgatgcccggcccttcgatccgctgacggcccggattcccgacgtgaatgcgccggtggacgaacggcccatcggcgggcttggcatccatctcgtgcgcaccatcatggaccgggtggcctacgagcgcgtgggcggtcttaaccgcctggtgctggaaaaagacatttgacatcgacaaagggggcgacatgcaactcgtggagaaggagagcggcgaggtcacggtgttggagctgggcggccggctcgacagcaacacctccaaggtgctcgaggacaaggtgatggagattctgggccagggcaaaaagaaggtgctcatggatttcgccgacgtggactacatcaattccaccggccttcgcgtgctgcttctggccttgcagcagctcaaaaaggttcagggcaagctggtcttgtcctctatcaaggactacatgaaggaagtcttcgagatttccggctacaccgagatctttccgatctttccgacccaggaagaggccctggccaatttttcctgatccccgaccgccgagaggaggacggatgatgccaagacccgttaacgcgccggcctggctcgccctggccgcgaccatggcctttacgctgctgctggcgggccggccggccctggccgccgaagccccgagttccctggccggcatccgcctcggggccacggtcgaggagcaggcggccaagcttgtgcccactgaagccaacaagacctttcatcggccggctcttggcatcatgcccgtggccgccctcaagggctttcgcagcggctatgtcgactacggcatgtgcgcggccaaggggcgggtggtgcggatcaagatgaactacgccgacgattcgttggagtttttcaatcgtatcctggaagccctcaagaaacgctacggcgagcccaaggagtggcgcggcaacgcctttggcaccctgcgcacctggaaatggagcctcaagtccaaggacctgggagcggtgagcctcattctcatgcattatgccggcgacgacggggcttttaccgacggcaactccatccgcatcgccgccaccgacctggtgcgcgccgaggaagtgtgccaggccggcgcgaccacggccaagaaggacgaacccaagcccggcaaggacgccaccattgaggccctgggcctggactgttttttgccgcaatagcttaaacgccattccccggcttgtcccaggcgcggccggccgcgcccaccgacgccatggccggcaaactacgggagcgctgtgaccacgaccttgcttgaagcgcgctatctggccctgcgcggcgaactgaccgggcacctggggcggctttgcgaactcctggccgcctgcggccggcccgagggcgcggccacggcccgcgcgctccttgagcacgccgccgaaccgtttcttttcgtggtggtgggcgaggtcaaggccggcaagagcagcctcataaacgccttgctcggtgccgaggtcacggatgtggctccggacccctgcaccgaccgcatccgcgtcatcggccgggaagagaccgtggctaaggccccgtccggcgatctggtggtgcgcgtggccgtggacaatccgctgctcgacggcttggccatcgtggacacaccgggcgtggacagcatcatcgaccgccaccaggagatcaccgaggcatttattccccgggccgatctggcgcttttcaccttttccgtgctcaatccgtattcccgctcagcctgggagtttttcgacctcgtggccggggcctggggccggcgcgtggcctttgccctgaccatggccgatctggccagccgtgagcagatcgcggtcaataccggccggctgcgcgagctggcccgggagcggggcgtcgaagatccggtcgttttcctcatttcctcggagaaaagccgcgccgatcccgaggccggcggcattgaggccctgcgccgccacattcgtgagctgaccgccgggggcgggcattttgccggcaagctcgacgccaccaggcgttcggccctgcgcctgctgcaggaacttggcgagagcctggacgaacgcggccgggaactggccgccgaccaggccgaggccgagcgcatccgctcgcgcctggacacggcccggctggccgccggccgcgaggccgaggtgctgcgcacccgggtggaggcggcctacgcccgattgtccgaggcgtttctggccgcttttgccgctgaactgaccttgggcgggatgcttggccgatccgtcacgtcgctgtggcggcggggcaaggacgcagctagtccggccaagcggctggccgaactgggcgaaaccttcgggcgcgacctggagcgcgaggtggaatccatcgccgccgtgggcgcggcccacatcttcgagagcgtgtcgggctatgcccgcatccttctggacgagctgcgcctgcgtcgcttggcctcgtcgccggcccttggtgatccgctgtccggcgagcgcgaccgggtgctggccgaggtggccggccgggtggagacccttttagccgaaggcggccccatggccgggcttgacgccaagtccgtcgcggccatggaccccagggcggccatgggcggggcgctggtggtcctgggcacgattttcgccgtgtcggtcaaaagcgcggtcatcgacgtcaccggcggcgtggtggccgccctgggggcgcttattgccggcagcgccctctactggcagcggcccaaggtcttgcgcgaaatgcgccgacggctggcccacggcggcgagaccctgcgacaggaactcgacgagcgtctctcggcccgcctcgaccgggtctttcgggagctggccgaccggttcgagccctttttcagtgacatcgcggcccgtggcgagaccctggccgactgtcgaacccggcgcgacgaactggacgaggccctgcgccggttttccacgcagtgactggaggcgggcacgggcttttcgctctgtgcggcgtttttcgcgtccgggggcttcttggccgggcgttccttcaccgttccttcgaggaacggagtccaacggctgtcggagcctttgccgcttctggtgttttcccttcaccgggccgtgacgccggcctcgcttaagtcgggcgtcagtccggccagggcggcggcgtcgcggccggccaccagcaccacggcgttgaggcggaagtatttgtcgcgccggatgcgcgtgagcgtcacggccgtgcccggcgggagtagggcggtcatggcttggcgggcctcctcggccgtctggcgcacggccgggtccgggtcgcgccgttcgggcgcgttcaccccggccagacgtacgcgtatcgccttgccgataactggaggatactccgggatgtccatcaccaccgtgtcgccgtcgcacacccgcaccaccaccgcttgcacctggccgaaatccgcgccggcggcgacaacaggcccggataacagccagcagagggcaaacagcagacaggcggcaggggatgggcgcatgggcaagttgtaatcgcttatttgataaaatagaatagtaaattttcaatctgtcttgccgcgacgacagctggccagcggccacggtgggggcaaaccggcaaaaggcttcgccgcaaccggcgcacgaccggcatgcgaccgtctggcccctacaaccagcttgacaaggcccgccggtttggcggaagctgcaaagtctttcgcgacatgtacggggcattggcttacgccgccccttgcgccaacattcccgatcaatccattcagggggagacgatggttctggagctgatacggcccggcacgaacatcaattttctcaagtaccgcaaactggcctacctcgtgtcggcggccatcgtcctggccggcttcatttcgctggccgtcaagggcggcccgcgtttcggcgtcgacttctcgggcggtctgtccatccaggtgcgtttcgccaagaccatggacgccgagcgcatcgacaaggccgtggaagaggtggggctcaagaacgtgacggtccagcgcttcggcaacgaagaagccaacgagttcctcatccgggcctcggaccatgacgtcaaccaggaggccgtgcgcacgagcatcgaggcggccctggccaagaacctgcccgactccggctattcgttgcagcgcctggaaatggtcggccccaaggtcggcgcggacctgcgcggcaaggccctggaagccattttctattcggtgcttctcatcgccatctatatttcgggacgtttcgagcatcgctggatggcggccggcctcatggccgcgggccttgccggcggcatctacgtgctcaagcttgtgggcgcatccacggtctggctcatcgtggcggccatggccattaccttgttcctgtgctttgtcatgcggctcaagtacgcgctgggggctgtggtggccgacctgcatgatgtcttcatcaccgtcggcatcttttcgctgctcaacatcgagttcgacctgaccatcgtggcggcgcttttaaccatcctcggctactcccttaacgacaccatcatcgtctacgaccgcatccgggaaaagctgcgcacaaccgacaagtccgtgcccttcgagcaggtcatcaaccagagcatcaacgagactctctcgcgcaccattctcacggccggcaccacgctcatcaccgtcacctgcctgtttttcctgggcggtccggtcatccacgactttgccctggccatgatcatcggcatcctggccggcaccttctcctcggtctttgtggccagccccatcctgctggacctgggttcgggcctgagcaagcccgaggaaccctcggcccctaaggccggcccccgggtcaacgccgcccgggcctaggctccggctgccccatcgcctgccaaaggccgtcccgtttcggggcggcctttttcgttggcggcagcgaattcgggctgttcggcgtcagatggttcaccagtcgtgtagcggctgagaatttagcccaggccgggactgccgtttaagcagtgccttggcccggcctccagtccttggttgccgaggcataggaaacggcccggctatcaagggcacaggcgtttcgttcaaggctggggcgaggaggcacagggcggggagaactgggatagggcaagtcggcttggacggcacttggcgttatcggctggttgggttcgatttcgccaggatcgagcagggagcacgtcgaaaggaaaccgctcgcccggggcggacaaattctccccctggccttggccccaacacttcatgccaaggccgccgcgaaaggccgaaaagcaaagagcgccacgattggcggcaaaggggctggccgttccagccggacgggaagacgctgtccgggcgtctactgggcgggcttgacgctcttggaggcttcgtaggcggccagctcccgctcgtagcggtccatttccacgcgggcggcttccttggcccggacgtagtggtccagggcttcggtgttgccgtccttgcgggcctcgtcctcggcctggccgaagcgaacgtaggcgttgcgataggtcttgaccttttccgccaggaattctctcttgtccggggcgatccagggatttttgggtcccgcgccacagccgagcaggaaaaggcacaatgtggcaacagggacaagacgcagacacggaagaatcatgcgatatggcttcataggaaatgcggggtttggctcatgacgccgcaaggtttggtcgtggctagagccggatgttgacgatgccgcccgagacgacttccaccgcgcccgccggagcaggtacgacgcttccggccggagccggttccacggacccggccggctggacgtcgaaggggccggtgggcggcgtggtctggaccatgccggccggagacggcgtggtcatgccgggaggcagggcctcgacatggccgggaggcagggcctcgaaccggcccggcggtcccgcttcgacgtgtcccgccggtgtgacggcgtcagacatggcgtacctccggcggcgatccaatcgccgctgctgcctatgtgccccacttcgggcggtatggcaacagccgcgatgcttacggtagagacagacgtctggtggggcgtctcccggaaatgggggcatccaaacggcgttacccgctctggatgccggcaacgggggcgacgtcagggcagggcctgtcggttgtgtaacggcgcggcgtcaggccgccttggccgagcgccggggccgtaccaacgtttcggtggccagtccggccaggtagagcacaccccgcaacagcagcggcaattgcacggaagcgtccttgccttgatcgtcggccaggggaatctcggaggtgtcggcctggccggtgaggcggcggtggatgacccgggcttccaggtggcgttcgttaagggacaagcccttgcgcacggcccgttcggccaggtccggccggcgcaggaagtggtaggccttggacagtcccacgtaggcgtcggcgttcttgggagccagctccagggccaggcggaaaagcgacacggcggcggcatagtggcggtcgcgcacgagttcgttgcccagggccaggaaggggttgaacccggcttcgtcggcggcaagcagggtgacgaactgatcgcgcagttcggcgaagcgctggacccgggcgcaggcgttggccgcctgcttcatgtaatggcgatagcggcgctggctgcccttggccagccaggcccgggccagacccaggtgggcttcgacgtagagcttgttggcggccagggcccggtggaaggccaggatggcccgttccacgtcgcgcacggccagggcggccatgccttcctcgaaatgcctcggcgcgtcgtccggggcctcggccagtgcctcgtagccccggaccgctccctcgacgtcgccgtccgcttccttggcggcggcccgggccagggcggctcgttcggcggcggcgaagcgcgccatgtgggcggccatggccagatggcggcggaaggtgtcttcggaataggggcgcagcaggaatccggccacgccgagcttgaccgccgagagcacctcggccttggtgccgccggtcgcggccaggatcaccgggatgtcggccagctcaggatcggcccgaagggcggtgacgagatcgcgtccgtccatgtcggccagggtcgcgtcgcaaaagatcaggctcggccgttcgcggcgtacggcagccagggcctcggctccggagacgacatggcgcacggcgaagatgcgggcctgcttgaaaaaggcgcggtccacccgggccacggcgtcgctggcggcaacgatgagggcggaagcgatggcgctggcggaagtggtcggcacggtcatgggcgcatcctggggtttggagccgggcggcattgccccggccttgcaaagcgtatcggccgaccgccgatttgcattagggccaaaccaaaaggaaagcgcccgtcggcattcccggcgggcgcttgaaaccgtcaggccaaaggccgactacagggcggagactttcttgatgaggcgcacgagctggtgggtaaacccggcctcgttgtcgtaccaggacaggaccttggccatggtgccgtcgatgacctgggaggccttggcgtccaccacgccgccgtgggtgtcgcccacgaagtcgatggaaaccagcggctcctcggtgtagcccatgccgtcgccggcggcggcggccagtacggccaacatgccggcggtgtccgtgggcttggccagctcgcaggtgaaatccaccaccgacacgttgggggtgggcacacggatggacatgccgtccaggcgtccggccaaggccgggatgaccttggtcacggcccgggcggctccggtggtggtggggatcatggacaggccgcaggcccggccgcgccgccagtccttgtgggagccgtcgagaatccgctggctcatggtgtaggagtggatggtggtcatgagcccgtgcttgatgccaaaggcgtcattgagggctttggccaccggggcgaggcagttggtggtgcaggaagcgttggagatgatcttatgctcgggccgcagctcatcgtcgttgacgcccatgacgatggtgacgtcctcgtttttgcccggggcgctgatgatgaccttcttcgcgccgcaggccatgtgcttctcgcaggagtcgcggtccacgaatttgcccgtggtctcgacgacgtattggcagccaagctcgccccagcgccattcgccgccaccgtgacggctgatcttgaccagcttgtcgttgatcaaaaggccttcgtcgcaagggacaaccgtgccggcgaaccggccgtgtacggagtcgtatttgagcagatgggccagctgggcgttgtcggcccgggcgtttatcgccgccagggtgatgtccggatcgtcggccagaagccgggtcaggtatctgccgatgcggccgaatccgttgatgccgatggtaaccgccatatgggtgtcctcctgggaagcagtgcgtgtcggatgctggaaacggccgcgccccggcccggggcctcggcggacgggtggcggcccgtccgtgagcgcggcgcatgataggccggggggcggttttgtgtcaacaaaacgtcgcttttgccggttggaaaccggccgaaatcacgggctttcctggccagttactggggcagcagccaggagtcgtccacgtcgaagagcggaaacgccggctggggttcgggcgcgcctttgatcatggcgtcgtagcaggctttttcccgattcatggcgctattgtcgctgacgcggatgacattgcccgagggcgagtcgtcgccggtcagttcgaaatgttcgagcaggacgtcaaggcccttgtttttgttggccccgaaaacccagcgatagcccttgtatttcgagccctttgggacgggcaagggctggggcacgccgtaacggtcgctgagctggcgcacgagcttgtcgaaaagcgccttggagccgtccttgtattgcagacgcacccgctccacccggttttgggtggcgcagccgccgaggaggacatagccggcggcaaagcctttggtgggcttgaggttggcccgcaccagccagggcttgtcccaaaggggggcgacccgggccagatccaggcggtcgcgcagatcttcggcgttggccccgatggcgatgccggcgatctggctgggggcgtcggcggcccgggccgggacggcggccagaacgagggcgagggcgagacaggcggacaggaccaatgggcgcatgggcggctcctttcccggatggataacgtaacgggtccacccaaaaaaccgcaatgccgggcattgtcaaggccgcgctacccttgcctggggccgcgccatggcgtaggacaaagcctcggccatttcccgggcggtttcgtccggttcgatttcaaggagaataagaatgtccaaaaaagccctggtgttagccgccttgatcgtcagcatgtccttcggcacgctggccgacgccgcttccaagaccccgaccccggtccaggcccagccccaggccgtcgccgtcggcggcggttccgccaccttcgcccacagctggtccgtctacacggacaaggaaaagcgctccttcctgtttggcctggccacggccgtgcgtctgatgtgcaccgacctcagcacccgtcagaaggacgccaagggcggaccgggcgtggagcagaccttccgcgactgcttcaacgcctacgccggcatggaccccgacgccgtggtttcggccatgaacgccctgtacgccgatccgaaaaacgccatgatccccatcgacggggcctatatgatttcgctcatgagggtgcgcggcgacaaggtggacgacatcatcgtccaggctcgcaagtacggcgaaggcctcaagaaagagatcgaccagcagcgtcagaaaggcggccagtaggtccggcgcgcgccgccttgccccagcctccgggatggttatcttggaagggtaagcagcggttttttttgccgcgagcttcctgatccttgagccaaggaggcgcgtatgtggatatgggttgcgcgctggctcgtccggcccggtcgggaagaagccgtcaggcaggcggcggaaaacgtccgccggcattggcaggaagtcagcctggacgtgggtttcgatccggccaggaacgtgaccgtggccgaaagcgacaaggaaatccgggtgggcgtgagcgaagagctcgacgccacgttccgcgaggaacccggagaatggcgctactactgataaccgcgacggggggtctgaatcttcaggccccccgtcttttttggcgaccgccaccgcatccccgttcgccccaactcggcgcggcgggccggcggcagcggttcgttgccccgcaccctcgccttgcgatggttgtcagggcgaaagcgttttcctatggtgtcccatgttccgttaggcattctccgaagccggacgcccgttgccggcgggccaaacgtcgatccccaaggaggcgccatgaatcgtctattcgccctggccttggccgttttgttgggaaccttgctggccgccggaccggccttggctcaggaaggcaaggcgaaaaaggaaaaaaccattccccatctggtgggcgtgtggaaaggcacatcggaaggcgtggccatgggcgcgctgggccatgtggacgccgccgccgcgccgacgttcgtgaaggtcgattggacgctgaccatcgacaagcaggaaggccgagccttttccggcacaaaagcctcgtcccgggccaaggagacagtagtcggcgtggtggacggagcccaggttgccatggtcgacgacgacggcacgtacgtcggcaagctcaccagtcccaatcggctgatcgtccggtatctcgaagccggcaaggcgtccaaggtggccagcatcaccttgttcgtacgcgagcgcgacccggaagccggccagacgccatcggccgcgccggcccagtagccggttatttttccagaggcacggatgcgggctggggcgttggcctcggcccgctttttttgcgcgggtgcagtgtgccgtcgccaaagatggcatcgtactgggccgtatcgccgggatgtccgtcgtagcagtccgaggcggcgatgggccgaccgccggccaacagttcactgaccgtcaccagggcatagccgcgtttgcgcagttcggccaaaagcgccggcagggcttcggccgtgccgtggccgttgccgttggcgtggccgatgacgatatcgccgggccgcacccgttccagggtcgtacgcaggatgcgttcgggcgtggaaaggggatcgggatcgccggtggtcaggctccactgcacggcggccaggcccaagtcggccagcagggccaaagcctcgggccggcagcggccgtaggggaagcggaagagcgcaggtgctgccggcacgtcgtccagggccgcctcgggcaggccccgctcccgggccagcacggccagcctggcccgcagggcggcatactcggcctgggtccagacaatctcccgaatcatgtcccggtcgtccaggcggccaaagttgccgtgagtccaggcgtggttgccgatctcgaacagagggtcgctcatgagctgcatggcccgcagcggatgggagcgcagccacttgccgccgacgaaaagcgtggccttggccttggcggcgcgcagggcgtcgatgaccccgccgtcgtagcccgaagtctggtcggccagttcgcacaggtcaaaggtcagcgccaggcgtttttcgccgtgggtgtccacccggcgtagcgacccgcgcagagccggcggcagcggcgtcagctccggggccacggtggcttcgggcggcgagcggtcgggttcgtgtacccggccggactttttctcggccggagtggacgccagctcggccggcgtccacaaggctgcaaaaagcgcttcccggtcatggccggcggctgtggcgggaagagcggcggcaagcagacaggcaaggcacagggcaacggcacggccgagacgtcccacggcaggctccttggcggttggaaaacggcgtgtacggggcagtggcccggatacgtggcatggcgggtacggccttggcaaggcccaaggcggcccaaacgcggcggaagcggaaacagcggcggctggatacggaagcgtccggccccggccgggatgcgacggccgggaccggaccggagggcggggcggtcggcgggctagtcggcgaccagcatgacgctggaggccttgatcatggccttgacgggctgacccacggccaatcccatggcttccacggagtgtttggtgacgacagacacgatttcaacgccaggcgcgatttcaaggacaacctcgctactgaccatgccgttgctgatggacttgacggtgccggggacaagattgcgggcgctgactttcatgcaggtctcctggttggattttattgagatactttctcgtaacagttcgtttttatgtaggtcaatgctgtcaatttatttgtacttacagtcactggaattggaaacaacatgtcgttgcgctggcgagacagtccttaagggtcttgcgtccggctttggggaacatctcgttggtgtttgaaaaatcctgttattcaaaggtgttgtcagccgtaaggcgcaggccgcgacggcctcgccctgattggcgatgagtaccgccaacaagggcatacgggtggagtagccgcagccagcggctggcgggcggctcagacgcggcgtgacgcgtcctgaacgatgtctggcgacaagtggcctcatgcgcggcaacaccggaaaatccaggctggggcagcgcctatggctcagggaaggacatcatcagggtggtccgggagcgcatgatcatggagcgcaaagcgggcggcacaggaaaggccgccgtccgggaggagttcgggcggcggccgcaaaccgtgaggcgaggacggaaacgatctgtcgcggccggtctagcggctggccacgtgcttggatttgccggaggcttttttctgggcggtcttgggggccggggccttgtcggccttgcgggatttcttgaccgtggcttcgcgggcgtcgaatcgggccgacgcgccgctgcgggcgttgaccttggcgtggcggtcggccttggcgacctgcatggccttggcgtggcgtttggcggaggcgcgcttggacagggacttggtcggctgctcgggctcgggcatgtcgcaggctgcgaccatggtctgcacggccccggagaaggaggcgtcgaggatgcgaacggcttcgcggttgcgcacctgcttggtgcgcccgccgagcaccacggcgatgacccgggtgtctccgcgtttggccgtggcgatgatgttgtagccgctggcgtcgacatagccggtcttgatgccgtccgcaccgtcgtaggaggcgagcaggcggttggtgttgccgtggaccgcgccgttgtggttgatctcggtggtggagtggtagcgcagggcttgggggtagtggcgcagatagctgacggccagcttggtgaggtcccgggcggtggtgtactggccggcggcgggcaggccgttgggatttttaaacgtggtgccggtcatgcccagttcccgggccttgcggttcatcaggcccacaaaggtgggcacgccgccgaaatgttcggccacggcgatgcaggcgtcgttgcccgaggccacggccatgccgcgcatgagctcgtcgagggtgacgatttcgccggcgcgaagccccatggtggagcctccggttctgtcggcgccccggctgaccttgatacgatcagcgaagctggccttgcccgaggccacgagatcgaaaaccacatacatggtcatgaccttggtcagcgaagccggggggattggccggtcggcgtcctggctgtacagcgtcttgcccgagccgtactccgtgaccagcgcggatttcacggccagcttgccggcgtttttagccggaaaggccgttcgcggcccgatcagacacagcaggatgagcaagaagagtacgcggcgcatgacgcctccctgtttcaataagtgatgtcgatgtccctgaaaccgtggcttcccccagccgtcgtcagggcagcatgatccatgccatcaaacgccacgcaaatggccgaactgcgccattaaaccggtatgtcgctggttttgcgggagcttgaaaagacgtcgccgacagcctccggccgggacgtccgagcagggcggacaatcgtttaggattgtcaaacgagccgtttgatattcttaaacactggcgctggcaagaaccaataggcgcaagtcgctgattttctcgactttgaggcagtccttaggaccgtctgaaccctccgcagagagcctgttcgtcaccactggtacgaattgctggtccgaatcgctggtccgaaaaggacggctaccgggccaggacagggggctccgatggctggtcatgcgccttcataccttgtgtcccgcgctgggactgttcacttccgtttttgccttcctgctgatctcaagccccgattcaagcggtccgaattgcgaatctcgctcgggactggacgcatgcgcgaggctcgggttaacagcgtgttgaaaaactccgccaagtgaccgagaatccagccatcggggttccggaggtgatctgatggggcttggccgtcagggtgatcagcaggggacgatgtatctggcctgggatgagatccctcggtctcgtgggcacgttttttacgatcgtctccagcagattctccggaaagccggcttcgatggtttcgccgagaagctgtgcaagcccttctattccgacaaggggcgtccctccattccgcctggccggtattttcggatgcacctcgtggggtatttcgagggcatcgacagcgagcgcggcattgagtggcgctgcgctgattcgctttccctccggaattttctccagctttcgcccaaggagtctgtgccggatcattcctcgctcagccggacacggtcccgtctgccactggcgacccaccaagaggttttcacctgggttctcaagctgctcagcaaggatggcttggtccttggaggccgcattggcgtggacgcttcgaccatggaggccaacgcggcgctcaaaaccatcgtgcgccgggacacgagtgagagctaccgcaagatgctcctgcgcatggccaaggagagcggcatcgactctccgatagatgaggatctggctcgcatggaccgcaagcgcgtcggcaagacgctttcgaacaaggactggcggtcaccggtcgatcccgaggcgaagatcgccaagatgaaggatggccgaacgcatctggcgtacaagcccgagcacgcggtggacctggacaccggcgcggtggtggcggccgaggtgcatgaagcggacaaaggggacacctcgactctgcaaacgacgctgaaagccgctcaagaaagtctgcggcgggtcacttccacaccgccatgcccggacgaccctgcggaactggtcgcggataaaggctatttctcccgggatgtcctcaaggttctggacggtggaccatggcggacgagaatcgccgaacccaaacgcaacggtctgaactcctggcgtggcgaccaagaggcgcgacgcgccgtgtacaacaaccgaatccggatatcctcgatggtcgggaaggccatgggaaaacagcggacggaactggtcgaaagaagcttcgagcatacgctggaccggtgcggcggcatgcgccgggtctggctcagaggacgagagaacatccggaaacgctatctggtccatgtggctggtttcaatctcggcctgctgatgcgggtcaagaccggccatggcacccccaggggctgggccagtgcctggcttgcgctcatttggcctgaccagcatccctcaatggcctatttggccatcgtcatggtggtcaagggacgatgctgcgggatcatccccatcgccatcatctgcgggggagaatagccggaaacagctttttgcaacggcctgttaaggccctggcgcttgctgccgtggtctattcgttcatcaacgccttgaggagtgggtcgatgtccgatcttacgagtgaagccatctccgagcttgttcggcaggaaatggtcaaagtacttgaggaagacaggaagtcacgcatccgtgagccttggtcctacaagttctcggtcgatttccccaaaccagacggcgcttatgacgatctcgtgcccgttgatgaccccgacaaggctcaggacatgctggacgacttcatcgctgagaagcggtgggacaggatgtccaagcctgtcatggaattgttggagaaaaacaagcacgacgtatcgccgtgggagccagaattcagtgagacttgctatcagtacacccaagggcttggactcgtgttggacgtgatccggcacagaaatgctggcgacattgagtacaatgtggagcctttcgcgcgtagtgagtcggaggtggtgaaggtagcccctgagaaggagcgccatggatacacaatctctgcactgctggagaagtacatatctgagaaggttgcgtctggtgcatggggtgaaagttctattgtagaaagcactaggcgtgttaggatgctgtttacgctcatgaatgacattttggttgactcagttgatcacgacttcgctaggacgtgtaaggagcggttgatagagtataagagcagggggaagtcgttgtctgtcgtgacggtgaatatgaacataaaagcagcgtccagcctcttcgattggatggaacgtcatggatacgttgctaagaactacttcaagggaatgttgcttcatagcaagcgacgggttagggacgagagagaagcgttctcgtcggaggatattggtaagatatttagccctgaacttggtggttgctaagaaagtccttccgtggcgttttggggttcctctgttgggcttgtatactggcgcaagggtagaagagatttctcagcttcacgtagaagatgtgaagtctgtggatggcgttttggtaatagacatcaacgataacgctgaggacaagcgcgtcaagacacgtgatagcatgaggatagtcccactgcatccttttttgttggacgagctaggttttcatcggcacgttgaacgtgttcaggcggcgggaagtgttcgtatatttccagagttgagacaattcaatttgaagtatggtctttctgtgtcagtatggttcagcaagtaccgcaaggaaattggtatcgaaggtgccaagtccttccatagcttccgtcacacattcaccacgaacctgattcacagagaagtccccgtccaagtcgtggattggctcacgggccatgcctcgccaggggagacggcaggacggtataccaagttgccgactgacccggtagtgctgttgccgcatgtgttgaagctcgactttggcgtcgatctctctcacctcaaggagtcgaagtttgccgtgaaagagtgacgccgaggcccatgcttccccccaagatcatcatcggcaagtcccctgtgtccaccaacgctgacggccttatcagcctgaccgacctgtggaaggcggcggggaagaatccctcgcaacgaatccccgagtggcttcgtcttcctgcgacgaacaactttgttaatcgtgtcagcgagaaagaaaaggtggggaaatcacaccttttgaaggctgtccctggccgtaacggcggaaccttcgcccactggcagatcgccctggcctacgccaagtacctgtcgccggaactgcacatggccgtcaacgatgtgttcatgcggtacaaagccggtgacccgaagctggccgaggaagtgatcgacaaggtcgaagatctggctgcgctggaacggatcgagcggcgggcacgggcgaaaaagcagtacaaacgtctggccagcgtggtcttcgccaagggtggtcaccgcaagaccatcgcccatggattctttgagaggcgaagctgtttgactgtgacgcgcacggatagtgggctacaaccgacatggggaccatatcctcgttcggagctatgctttggctcgttttgcctattggaaacccctagggcaaaatggccggatacaagatcaagtcaaggcgtcgtcttggctgtcctatgtggatatcctgcaggccgagtccgccatctcccctggtagtcacttcgatgtctagttcgtcgatagacgttctcgccgatgatacccgcagaaaggcttcctgttcaaaagagttccacccggcggggactggagccttggctgtggaaaaacgggcgctttgcattgggtggcgaagagtcacatcgcagaatccggccggctccccgggggatgcatgggggaaaaagaccaatgccgcggcctcgacgggctgccgcaatcgtaggtgcaacctcgcgtggccttctccgccctctttggaagtcgtgaggtatttaacggtcctgtctgcagcatactcaaggaccatgttgcgctggtcttgctccgaggccgccacgagccagttttctggaagcacaaatcggccgtcgtcgtcgaaactcaggctgatggtgacggggtcacggtagcgcacggcctcattggcagggagaaacacagggggttcggcttcgccctgggcaattcggtcggcaatggccctggcaatggcggcgtttccggctgcgctgcagtgcgtgtccaacggctccagaaaagggttgattccctggtccaggtagagtctgcgaaaggtctcagtcatgtccagggtcttgatgcctcggttccggcagtgctccaggatggccgcgctggggccgttcttgtagtcgtgcagttggtcggggtcgggcacgatgacgagcaggaagtccatgccggcggcggccgcctcctcgcgcaacctgttcgcttcatccagatagcgctgccagagaggggccgtgaaggctaggtagcgttcgtcgagaagcttgtctttgttgccggccactcgtttggccaagcgcaatcggtcttgttccggggttgaggtcgcactcgtcgtcggcttgggctgcagaggcggttgtgaggtgagaaatatgaaaactgggttggcgtgcaaggcttggacaagggcaacattgacgtcttcagccaacaatcggtcttcgagcggggcgaagggcttaccttttctgtagttctgaacctcaacgtccgaacggagcaattctatatcatagatattgaactggagcaccatgaggtcggccggcattcggttggcctttgtctggaagtaatgcaggttttcgatgatgccgatgcccatgaccccggcgttgacgacttggaagcggttgggcccgggccaggaattgagcagcatttggagttgcgatggaaaggtttgcgcgtccggaacgccaaaaccgaaggtataggagtcgccaatgcacaggatgcgtctattggcttgcgccacgggaggaacactatttcgtagcccctgcttgtccgttgtgtagagaaatggcaagtccgggtgccaacgggccacggcccgcacatccggcctgagactgccggcaaggtcggaatagaatttaggatggggtagccggttcaaaatgctggggtccaggcgataggccacttccagggtcaggtaggaaaagagcaaggcaaggaagatcaccacttgccagatatgaattcgccgaaacaaccgccaccacctccaaataaatggttcatatgcccccttcgtggtgtggccgctcaacgggcggatgacgaagaaggcgtgcgtatagtcgcttgcccggtcgttgcgtagtaggcaagtcatgtagacactcaatgactggcaatgagtctagcggaattgattccggtttaaaagtctgggtagcttggcgtacacagattgttcttggccgtgtgggcaaggaaggcatccccgagaagcgccagggtccgtcctacgagtccaaggctccaaagccgagacgaagcgccggaagttgagccagagggtgaggaaggaaaaggtactccaggcgtacattttgccgaaacaccttctgattccaggggaaaatcgtggtcgcgtccgtcaatgtggtgtaaattccggtgtgcttgaggtggcaatcggtcaggctgccctgagtggaatttgtgctggctgcgcctcgttgggttgggggttgagttcggccatggcctcgacctgcatgtagcggctttgcagttgccactcgtcgttttgctccagcaaaatggccccgatgagctggatgatggaggcttcgttggggaagatgccgaccacgtctgcccgtcgcttcacttctttattcagcctttccagcggattggtgctgtacagcttgacccggtgctgtgccgggaaggtcatgtaggccagcacgtcgtgctcggtttcatccatgaaggtggcgagctttggccatttgccgcgaagctggtcggcgacatgccgcaggtctggctggcgcctgccgcatccggctgtaaaaaggcttggcgcagggcggccgagaccatggcgtgctgggacttgggaacccggaccaaagcgtttcgcatccagtggacccggcagcgctgccacgtgcccccgaacgtcttggctatggcggccttgaggccttcatgggcgtcggagacgacaagcttgacgccactgagtccccgacgaagaaggcctttgaggaaaaaagaccagaacggctcggcttcgctggggccaatgtgcagccccacgatttcccggcggccttcggtgtttgccgccacggcgattatggcggcgacgctgaccacccgaccgccttggcgctgcttgaggtaggtcgcgttcagccacaaatagggccattctcccgtcagcggccgaaaaagaaaagcatggacccgttcatcgatgtccttgcacagcttggacacttgggatttcgagatgccggaaaggcccatggcttggacaagatcatccacgcgccgcgtcgaaatgccgccgatccaagcctcctggatgacggccaccaaggcgcgttcgctggtcttgcgtggccccaggaagggcggaaagtagctgccctggcgcagcttggggatgcgcagttggagagagccgacgcgggtatcaaggctgcgctcccggtagccgttacggtagctgactcgctcggcgcttcgttcgtggcggctggccccgatcaagccatccacatcggcttccatgagaagctgcaaaacggcttctgctaaggagcggagaaaatcaccgccatcggccttttgcatcagctcaattaatgccatgctgtcctcggccatcgtggtctcctttggttgtaggtgcggcttcgcaacttcaccttacagccaattgacccgatggccacctcgcccatcccgtccagactggaggccgccccagcctggacgactccagaatttacaccacctccgtggactctgcccgtgagccgggttctggtctggggcttgagtgaggtcgaagccgggaagaaacccagcagcgacaaggactcagcaactcaagaggaaggttcaagagtcgctcatgagtcgatcattccgccagagcttgaagcccgactccaggcaattgaggagcgtttggcgaagctggaaccgaaagcgagaggtgacatctgtctggaggccctgtagacgaggccaccaaacccgaattgagccatgcctctctcgattgctgaccgcagggtcaggaggtgagagcgaaattccttccggttcttcttgatctcttctccgcctcccgcctcctccgacctccctttccctccatccttctccattactcaaacgccaatggagataaatagtgtagtcgagggtaaattcctactgtttcagtgagattttgtgacaagccagggactgaaaggctgggcaggggcatgagggtgagaatggcggtcaatgattccgactatttatgtcaaaagtagcatagctcaggagcaagggagacgaagtattctcgtactcagtccgccaggggccaggggtcgagtggtacttgtggctggtccttcttgttggtacgaaggcagtcatcgacagaggcttcaggttctctgctcagacgaaaaagtctttaaagtcgagctgttatctgcgcttgctttttggtcccgccaaacgagctgtttgatattcttaaacactggcgctggcaaggggatttggcgcaacccgttgattgtatcgacagaccgcggccgctgcgggcgggcggagctggacatcccgcctgacgtcgtgcacaggcgtttttatggctgggccctgtcttgcaaggatgttacggggctcaggcccggcggggcgcacgtggccttgaggcaacggccagacaccgtcagtggcgtccgggatgttgcttccggtcagacagcgtgcgacactggttcgcagacatggagaatcgcatggtcgatgatttgagcctgtccatgaatatcccgccggacaccgcgttcgtctgcgcggtggtgcaggcggccaaagcggcggcggagcgcgtgggaatgagcccgcgggaaagctatcgtttccaattgacggtcgaggagttcagcctttgtcttatgggccttgcccagtccggtgaaccgttgcgcatcgatctgtcggggaaacggcatctgctgcgcgcggcgttttcgtttacggcctcaaacctgtcgttgggcggactcaacatcacggcctgcgccgcggtccgggcgcatgacgaaccgtctcgcggcctggggctgctgctggccgccaaggcggcggaccgatttcacgtcgaacatgttggcggcgaccgctttcgcatcgtggctgaagtggacaggcgctatccggagtggacgccggtccatgccggcgaccagccgcgtctgccgttgcggctagcgcatgacctcgatccggctcggctttcccaggccgccgccctggctgtgggagcctacccggtctggcagtgtcctggtgcgtttcgcacgccggaacgtttcgcggatctcgttgccgacggacaggtgtcttgcgttcgcgccgttgacgccgccggtcagaccgtgggcctgttgacctggtcgccctgcagcgagcaggccttgctgttttccgggccctttgtcttcgccccccgggaaacgcgcgaagcggcggccaaactgcttgtcgaggcgtttttgcaagccgtggctcgccagcgctacgccattgtcctgagctttcgggcgactgccgatctgccgtccggctatttcgagtccctgggcaatctccaggccagcgccgaggatggctgtcgccaacaaccggtcattttccggcatctgcaggaagacatggggcaggccgtgtggtgcagtccccggatcgaggactttgtgcgccaggcctacgaccgtctggccatggcccgggatctcctgcccgtggaagagtcggccggccgaccgaggcgcgaatccctcttgggcacaaccctggaccgaccccgcgatctggccgaactgcgcccgtttttggatggccaggacatggccgccaatctggctgcccatgtagccgccatccgcgacaagggcattggccgcatcctgttttacatggacttggcccgcccctgggaggcggccctggccggagacctgctccagtccggtttcactccgaaagtcgtgctgccctacgccgggcagggcgacacggtcgtctggcagcatgatcagccttgttgaccgcgtgccggactatgtccggtctttcgagcgctatgtcccaagccgccccgatacggcgctcatgcgccagtacggggtgtcgcacctgcatcgcctcaacaacaacgaaaatcccctggggccgccggccttggcctgcgaagccatcgccgccttcgctccggagcgggccgccgtctatcccagcggcgacgcctacggcctgcgggagaccttggcggcgcgatttggcaaatcccccgagcaattcctggtcggcaacggctcctgcgaggtcatcagttccgtgatccgggctttttgcgggcccggcgacgccgtggtcaccgccgacaaaacctttgccgtctacgaatgggtggcccgtttttcgggcatcgaggcccgccttgttccccttgttggccaggcttacaacccggccgggctgctggccgccgtcacggacaacaccaagatcgtctttgtctgcaaccccaacaatcccaccggcgattggtggaaccgggccgtgctggagcggtttctggccgcactgggcggccgggccttggtggttctcgacgaagcctactgcgaatacctggacgatcccgactatcccgacggcatggaagtcctggagcgccacgacaatgttttggtttttcgcaccttctccaagatgtacggcctggccggattccgggtgggctatctgtgcggttcccgggaggcggtggactacgtgcggcgcacccacatagcctattcggtcaacgccctgggccagatcgcggccacggcggccctggccgacgacgccggccatatcgccgacacccggcgcatggtggccgaggccagggggtatctgcacgatctctttgacgccatggggctggaatacgtcagcggggccggcaatttcatcatggtcgccgcccccgtctccgataccctgctctaccggcgactcatgcgcgagggcgtcatggtgcgcaccatgacgggctttcgctaccccaactggattcgtgtcaccctggcgcgcgaaccggccatggaggcctttgccaaggcttttcgcaaggtactggctatcccgtgaacgaccgcgccgtatcccggcccgagcggcttttcagctacgacttcatcgtgctgaccctggcggccgccttcgggttttgcaacatcgccgtcttttacggcttcagcgcctatctgggccgcctgggagtggacccggcctggtgggggccgctgctggccgccgaacccctggccgctttttgcctgcggccatttttgagcctgctggtcacgccgcaaaacgccctgtccatcgccaggtggtccctggtcggcctgggggcggcccttggcggatatcccctggtccacggcgtcgcgctgctcgcggttgtccggctctgtcacggcgtggccttcgtgtgtctggtcagcgccgtcacggcgctgctcgcccaggccatccccaagagcctcgccggccgggcgttcggttatttttccctttcggccctggtgccttatgccgtcatgccgcccctggccgaggggctgctgccgcttttgggacgcgaggatcgggtgtacgcgtgttgcgcggtttttgtgttgccggccctggcgttgctggccccccttgagcggcgtcttgggcggcgggccatggccgaggtcgcggggacgagccggccgacgctagggcagatgcgccaaaccctggctcagccgtcggtgcgcttggtgcttgctgccaatttgtgcctgtttttgagcaccaccttgattttctttttcatcaagccctttgcctcgggccttgggctggccgatccgggcttgtttttcacggtctccacggccgcttccatcgccgtccgggtgctggccggggcggcctacgacaaactgccccgggaaacgctgcttgttgccgcgctgctcgctctggccggctgtatcgccggttttgccgacacaagcggccagggccggctcctggccctggccgccggctacggcctgtgcctgggcgtggccatgccccttgccaacgccatcatgttcggcttgtccaagccggccatgcgcgcaaccaacttgaacctgatgctgttcatgatggacacggcttacgtgttcggccccttggcaggcggcgcgctgctggcgaccggggccggctatccgacgctgtttcttatcgccgccggctgcgccctggccgccgggctgcttatggcccctctggccgtcgtcggctggcgcgccttgggaaaagtgcgatagtgctttatgaagcaggataaatttagcctagtgacggcaaagtgccctcggcggcttttcaagatgcggcgctaaagaccaagaagtcgcaagggaaggttgccggccagacgcaggcgataggcggccgtggcccggaggtcgtcgatgggcgagacgtcctcgcggaggcgttggccggcctcggccaggctatgccggtcgagacgccggccgagcagacaggcttcggcctgggcgcaacgacgcgccgtcggccccaggctgcctacggccaagcgcgccttggttacgcatccggcctcgtcgcggacgatgacggcggccaggctggccacggcgatggccagggcgtcgcgtcgcccgaccttctcgaaatggtgcagtgcgccggggggtggcggactaacgaggaccgccgtgacgatttcttccggggccagggccgtgcgtcccggaccgaggatgcactcggccagggggaggcggcggatgccctggcgtgaggccagttccacctgggcgtccagggcgtgcagcggcggcagcgtgtccccggccggggaggcggtcgcgatgttgccgcccagggtgcccatgttgcggacaagcggcgaacccaggacggacagggcccgggccaaggccggcaggcgctcgcggaccaggggatgggccaggagccgggcatggcaggcggtcgcgccaaggcgaatgagtccgtcttccaggccgacggcgttcaggccggagatggcctccaggagggccacgtcgcagggtgtttgccgctgcctcaggcccacaagcagatccgtgccgccggccatggggcgcgctccgtcttccagcatgggccacagcgcttccagactgtctggccgcatgacccggccgatcatgacttttcctcccggatgaccgcggccgcagccatgacggcgtccacgatcttcacgtagccggtgcagcggcacaggttgcccgacaggccctggcgcacggccgcccgatccggcgcggggtcgcgagccaggaggtcggcggcggcgatggtcatgcccggcgtgcaatagccgcattgcacggcgccgcagtcggcgaaagctgtttgcaggggatggggcgcttgggggctgccgagtccctcggcggtggtcagcacacgtccttcgagttgggcggcgagcatgaggcaggacagcttcgccgtcccgtccaccagcacggcgcaggccccgcattcccccgtgccgcagccttccttgacggcggtcaggccgcaagcctcgcgcaggacgtccaaggcccgcgcgcccggcgcggcctggacgctcacgggttcgccgttgagccgaaacgttagtgtttggcgttccctcatgaaaaagcgtcctccatggctgcaagaacctgttccggggaaacgggcaggcgtgtcgcaaaaaaaccagcggcgtcctggagcgcctgggccacggccggaccgggcccgtggacggcgatttcgcccatgcctttaagtcccatggggccggtgggttcgtcgtcgtccagggccagacagtccatatccggaagatcggcggccgtggggagcagataggtgcacagatccccggccctcatatggccatcttgcaggaccgggtcttcataaagagccaggcccgccccctgggccgccgcgccgtggagttgctgctccacgccctccaaggaaaacaccttgccgcaggccacggccaggaagcactggaccagccgcgccgtccccgtcagcgtatcgacctccaccccgcacaggcaggctccataagcatagaaccggtgggggaagccgaagcggaattcccgccctgtggccggtgggttttggaccacggccatggtgtgctggtcaatgcagatgcggtcgtcgcgggagaggaaaccggccagcacggccaggggaacggcccggccggtggccggatcggacaccgcgccgggcacgaggacgaggcggtcgggttcgtcgcacaaaagcgccaggcttgcccggtggcgcagtttcgtggccatggcccggcaggcgccaaggagcgcgttgccgaaggtgtaggtggttcggctggccgaggaagagccggccggggggcagcgttgggtgtcgggctgcaggagggtgaaagcggtttgaggctggttgagggccttggcggccatggccgcgaaggtcggggcattgccctggcccatgtccggcacggaattgtataggcgaaacgtgccctggcgcgtgagttccagcttggcggcggcgtggtcaggcaggccccggccgtagcccatgccgttgtgcatggcggtcaagcccacgccgcgccggataaacggcggggcggccattttccaggctttccgctccgcccacagcggatgggccatggcggcgtcgaggcaggcggccacgtcggttccgggttcggccgacacgccgacgccgtttgcttcgccggcccgcaaggcgttttgccgccgtagtccggccggatcgcgccccagccggccggccagcagatccatggcccgctccatggcgaacgtcgcctgcaccacgccaaatccccggaaagctccgcccacgggattgttggtgtaggcgcaaaggccctcgacgcgggtgttggggatgcggtaggggccggcagcatgttccatgccaagggccatgatctcggcgcttaagtgggcataagggccgacgtcgaacagcatccggcactccagggccgccagcgtcccgtcggcgtcggctcccaggcggatgtccatgacggcgcgatggcgcttgtagccggccaggaaggtttcctcacggctccaaaccatcttgatccaccgtcccggaacgcgcagggcggccagggccagcaggcactgcaccgtggctccgtccttgccgccgaaaccgccgcccaggtagggtgcgcggacgcggatgcgctggggatcaatccccagggcctggccgatctcgaaacggtcgcgaaatggggcctgggtggagacgaccaggtccagccgacctgacggcgcaaggcgggccaggccgtttggcggttccagaaaggcgtgctcctgcatgggcgtctcgaagcgtccttccacgaccacggcgcaccgggccagggcggccggcgcgtcgcccttttccatgagcccccgggccagcagattgccgtcgtcacggccggagtgcaccaggggggcatccggggccagggccttggccgggtcaaacacgccgggcaacggctccagggtaagccggatgcgggaaagggcctgggccagcgcgtcccggctttcggccacgaccagggacacggcatcgccgcagtggcgcacgcgattgccgcacaacaccggttggtccttgtgcacgatgccctggcgattggttccaggcacgtcagcccgggtcaggaccgccacgacgccgggtgtttcgcgggccctggccgcgtccaaggcggtgatgcggccgtgggggatgccggcccgcagcgccccggcccagagacagtccgggggcgtttcgtccacggcgtaccgctcccggccgcaggccttgtccagggcatcgatccgcatacagagggctccatctggtggtgtcgcctcgcccgggggccacaggcgttttttccggcggcggacggtttgaggtccggggaaggtggcctctccgacgcggggcaacaggtcatttatgaaatcgaaacatggcgtatttttgggaagatacctgttctgtcgtcgcgggacaagggcgtgaggccctgatggcctgccaaacggcacggcgggcgcttgttgccgccgcgtttgaccggtcctggcgggcggggtaggggtgacgcattccaacacatgggagaaggaccatgcgcgacggagaaaacgccgcccgggccatcttggacgccggcctggctttcggggccgagcggccggcctatctgtggggcgacgccgtattgccctacggcgcgttggacgctcgagcccggcgattcgccgccttcctcgccgcacgggccatagccccgggcgagcgcgtgctgctggttttgccggatacgcccgcctttgccgtggcctttctcggggccatgctcgcgggagcctgtcccgtgcccctcaacacgaatttgacgactgaagactatgcctttttgcgcgacgacgccggagcccggctcgtcgtgaccgtcgccggccataccgctcttggcgcggtcacgcaggatgtccagggcgtgtgctgtaacgatctggggccgccggaaatcaagaatttttcctcagagttggctgcacatcccgctaatgatgccctgccgggtttcatgctctacagttcggggtccaccggccgtcccaagggcgtgccccaccaccaacgggatctgctgattccgtccgccacctgggggcacctgctcgggctgtccggccgggacatcgtcttttcctccagcaaatgctttttcgcctacgggctgctggcgaacttggcgctccccctggccgtgggggcctcggtcgtgcttttcccgggcaaacccggccccggagaggtgtttgacatcctggccggtcgcagccccacggcgtttttcggcgtgcccacgctctacaatttgatgatccggactttcgagcccggcttgcgccagcacgtgccggcgatctgtttcagcgcgggcgaagccctgcccggtgtgctgcacgagatctggctggagttgaccggccgggagatcctcgacggcataggctccaccgaggccttcaacgtgtttatcgccaacagcaaaggcgcgtcccgggccggtttcgccggccggcctgttccgggcttcgagactcggctcgtggacgacggcggggccgaggttgcgcccgggaccgagggcaatctgctcattcgcggtccggggctgtgccggggctactggaaccgcccggacaagacccgtgaaaccatgttggaagacggctggatgcgcacgggtgatgtgttcgtcgaaaaggacggctggttcgcccatctgggcagaagcgacgacatgctgaaatccggtgggcaatgggtgtctccggtcgcggtggaggaagcgcttttgcgccacccggccgtggccgaatgcgccgtggcggcccggcgcgtcaacggtctggacgtcgtgtgcgcctatgtgacgcctgtgccggacgccgggccggaaaaggcgcttggggccgcctggcgcgagttcttgcgcgcctgcctgcccgagcacatgtgcccggcgctttttgtgtgcgtcccgcagctgcccaagacggcgacaggcaaagtgcagcgcttcaaactgcgccaactataacgaccggatcggagtgggccatgtctgtttcccttgacgtcttgcgcgagttgcttgttgaagccggtgttgccgccgacgttgccgaggccatccgaccggatgctccactgctgcgccagggcgtggattctctcaatttttcggctttttgcctggccgtggagcaccgaatcgggctgtccctgaacgaacgcgacgccctgaccctgcggactcttaacgatttcgtggggtatctgggcgcggcccgaaacgatacgccgccggccgatcctgtcggacggatcgtgcgaaactggcgggaggttgaggccggccgctcctttgcggtggggccgttgcgtcctggcgacgggcaaggcgtcgcccagctattttacgccatttacggcgatcgctacccggtggaagattattacattcccgagcgcatcgaatccttgaacgcccagggccatctgctgaccgtggtggcccggctggagacgggagccgtggccggccagggggcctattaccaaagctccccgcccaacaaggccctgttcgagttcgggcaggtgatggtcgatccggcctatcgaaacacgaccatggccgccaggatcgtccgggaaatggaacgcctgtcgcgactcatgccccaggcggagggctttttcggggaggcggtgtgcacccatttggtcacccagaagctcgtggacagacacggttacgcggagtgcggcctggaagcggccctcatgccctccggcgcctacgagaaggagggcgcgggttccctgcgagtgagctgtctcctggctgcacgcgtcgatcgcgaccggcccatgaaaatgcatctgcccgaatgttatcggcgggaattggcctacattctggaggggttttccctgaaccgcgacatctcgttcgacggacggcaggagccgaccatccgggaatcttcgttggaacgacgccttttcgactttgcccaggtcgagcgagtgcaggccgtcggcatcggggctgattttcccgaacgggcggccgtcttggatcgtgaggcggcgcagcgggggctggccgtgctccaggtgttcgtcaatgtcggcgatccgggagcggcattggctgtggaggctttgcgcgagcgcggttttttcctgggcggcctcattccgctctggttcggcaccgacgggctgctcatgcaaaaggtgtatgtcgcgccagaattcgaggccatcaacttgtattcgtccagggccaagacgcttttggaattcattcgcgacgactacgaccgtattggcaaatagccgcacaagaatgcgtttttttcctgtctggaaacggccagggaaacggcgttcgttggtgagacgtcccgttggcgcagatgagacgggggagattgtcgcgaaccgattgtcgagtgccggttgaagaccaacctcgccgtaggggggaatttgtctttaggcggcaaaatggcaaaggccgtttcgccgcgcgtccattttctggtccctgagagcgggctgcatggtgctcaaacgccgtcgtcgggcagtgccagccggcgcaaggctccgattttctccagatactcggcgcggtaggcttcgccgttggcggtgaaggcggcggcgcgtttcgcatggacgtcgcaccagccggccagggcgggaaccgggcggcgcgcgccgtaagcccgcaccatgtggagcagattgtggcacaccggcatgtgcggggcggcctcgacgagcaggtcggtgaagtcctcctcggggcgcgccaggaagttgcccacggcccgggccgcccggtagttggagccggagacgaggtgttcgagtagggcgttgttgtccaggcgttcaggcgaccatgtaccgcgccaggcctcgggcacggtctcgtgtgggagatagtcggcccggccggccgccaggctccgaacgatggccgccacaagagcgggccagaggctgccggcatgttccaggtcccgggccatggccgggtgatctgggtttggctcgtcggcgatgcgcaggaaggggaagtgggcctccaccggaaggtccgagcgggcaaaaacgccgcccatgacgcggtcggcgtccaggaaggtgaccccgggcaggccgtccgcccaggccgcgaactgccgggccggaccatcccaaagggcgtcccagccgtcgagataggagtgaggcgcggggccaaggccgggatagtgccccatacggccgatgacgaggatgggcacgcccggcagtcgctcgcgaaagagcagcagcatggccgcgaaacgattgagatagccagccggattgggcacaatggcgtcgaaatggcgctccatggcccgcttgaggccgggcttgcgctccagggcggccgggtcgaggtagaagcagtatttttctattttatgaagtaaaagcggccggttttcatggaaaagattgaccaccagcgcttcgggccggggcgtggccggcggcggggtgaactggtcgatcagttcacgggtgtgtaggtattcctcgaccctggcaccggcgatgagatcagccacaagccgcggcacggctgccggcgaggcggtcagggtcaggggcgaggccagggaggcaaacgagacgtccaggccggcggcggccgccgcctcggcgcaaaactgcatctggcagttgccgcgaaaaaggatcatcttcggcctccaggctcctgagggttcacgaataggcttgctgctccgccttgcgcggcatcccgcatcaggcaatggaattatttacaatgcgcagaatttcagggcgttgcgcggggcgcaggcgagatgccttcgaggtcgcgccataagcgtcaggcgtccccgcatgggggcaacgcctgacgcgtcaggagataaagcgcgcccgacacgcggcgggccagccgcaaccgtttacggcaaggggcttgcagacgcgtcccgttgtgggactttattgccggtagcctatgtacatcaagacgttttccatgcagccctacgcggtcaacagccacctcgcctggatcgactccggcgaggccgtggtggtggactgcggcggcgaacccgagcggatgctcgacgagatcgcgacccgaaagctgcgccttggcgcggtgcttcttacccatctccaccaggaccacatcctgggcgtggcccggctcatcgaagcgacgggcgcgtccgccctggccccggcagccgacgccgccctggccggccagcccggctacggcctcaaaatgcccatgccggacgtgccgctttttgctttcaagcccgtgcccctgggccggacggcgtttctgggcgaaccctgtctggtgctgcccgtgcccggacacacgccgggccatgtggtctattttttccccaagtcattggcggcctttaccggcgacacgctctttcgggggagcgtggggcgcacggacaccgcctacggcgacgccgacctgctgttgcggtccatccgcgagcggctgctcgtcctgcccgaggccgtggaatttttccccgggcatggtccctccacgacggtggcccgggaaaaggccgaaaacccctttttcgcgctaaaagcgccctgatcccttgatgtggggggacaaccgccacagaccgggtcggcgtctccaggctttccctttgccggggcggcgtgtaccttgccgcgaacaccgttcacagcgcgcgcccgcattctggccgggacgacgttcaaaggaaagaccatggcagccatcggtggttcggacacgtttctccttttttccgacgtccacttcaatccctttgccgatccgtccctggttccggccttggccgccgccgacgtgtcccaatggaagaccatcctggcctcttcgagccagactggctacccggcctacggcagcgacagcaactacgtccttttcgaatccaccctggacgacatggctggccgggccggcgacgtggacctcatcctctatcccggcgacatcctgggccataatttcggcgcgaattacgttgccttgacgggcgattcgagccaggccggttatgaatcctttgtccttaagaccgtacagtttttcgttcaggaagtggacagccgcttccccgacgccacggtgctcgtggccgacggcaactgcgacaccgacgccgtgccaaacggcatcggcgcgcggcccggcgacgcctatctcgccagcaccgccccggtcatcgcccaggcgtttttcaacaacgacgcggaccgggcggcctttaccgccggttattcccaggccgggtactacgtgctggaacccgacggccccacggggctgaaatacctcgtgctcaacagcaacctgtggatcagcgagtacgacgaccccacggccggggccatggaaatggcctggttcgcctcggagctggccgattcggcccgggatttccagaaagtctgggtgctggggcacatcccgcctggaaccgctgcctccggcgtggtttcgagctatgcccagaccgggcagatagcctatcagggcaacatggaggacacattcaacaacgccttcgtgtccctggagctggcctattcctccaccatcgcggccacgtttgccggccacacccactccgacgacttccggctgctgaccgccatggacggttcggacgcctcggaactggtgcgcatcgctccgggcatttcgctttttcttggcggcaaccccggctatcaaatctacagctatgacgcccagacctttgccctgcaagacgagacgacctacgtcctggacgtcggcgcgagcaaaccggcctggagcctggagtatgattacgccgcgagctacggcgtcggcctggccacgccacaggagtggcaggcggcctatctcgccgtgctggccaatccggccagccagacgacctatctgtcggcgctcaaccagggggccgacaatcagaccgccgtcaccgccgccgtcgcgccgatctatttgatgacgccggggctgacgacgccggccagcttcaacgccgtgggcgctgtcctggccggataaagcgagacgtcccgcgtcggttccgcccgagacagggcgcagccagcccagccacaggccgcagcctgcgaagctccatcagtttgggcaacgagcaaacgcaagaaaagcgcgtcctgtcggccgcgcttttcttcggccgaaacggccaaaaatcctatgatctcaccttggcggcaagcctgccgccccgtgttcttcaggaatgccggcccaaaggcccgcaacccaacgctccttcgtttcgccccaactcccgcccgccgtagcagccaagctcccgttgcccccttcaccccttttcccgtttggggggtctgggggcctcaggcccccagccgccggaggcactctttactcttcactcttcacttttcactcttctcttcccctaaaccccataaatcgccgaggccttggcgcgcaggtggcgcaccaggggggcggcggtgggctgctggccggtggcggcggcgatgagcgcccgagggggcagttggcggcccttggcgtggatgttggtgtgcagccactggagcaggggggcgaaatcgccggcggccatgcgttcgggcaggtccgggatggcccggccggcggcttcgaacaggcaggcggcgtagatgttgcccaggctgtaggtggggaaatagccgaacgcgccggttgaccagtggacgtcctggaggcagcccagggcgtcggtgggcggggtgaggcccaggatggcctgggatttttcgttccaggccccgggcaggtcggccacggcgaggtcgccgcgcacaagcgccagttcgagttcgaagcgcaggatgatgtggagattgtaggtggtctcgtcggcgtccacccggatgagcccgggccgcaccgcgcccacggctttgaccatggcttcgggggaggtgcccgccagttgcgggaagcaggcggcggccatgggggtgacgtgtcgccagaagggcaggctgcgggccacctggttttcccagagccgggactgggattcgtggacggcgaaggaagccggttcgcccatgggcgtgccgtagtggccgttgcccacgtggccaaggctatagagggcgtggccggtctcgtggacggctccgaaaaaggccttggtgaagtcggctgggtcgaagcgggtggtgatgcgggcgtcgccagggccgatcagcgtcgagaaggggtgggccgagacgtccaggcgcgaggcggtgggcgacagtccgataagcgcggtcacctggcgcaagagcgtttcctgggcggccgtgtcgtaggggccgtccggcagatcggccggggccggggcgtccttgatgcggccaaggatgtcgacggcggcgtcacgcagttcggccaggaccggggcgatggcggcggctttttcgccgggctcgtacaggtcgagcagggcgtcgtaggcttcggtctggtagcccagggcctgggccttttcccgggacaggtcgaggagcgtttggagatggggggcgaaggcctggaaatcgttgtccttgcgcgccagttcccaggcccgctgaccggtgctggcggcctgggccagggccacggccagggcttcggggattttcacggcctggtcgtagtcgcggcgcagctcccggatgttggccgcctcgggcgtggccgggtcggcggtcagttccgagccttcgcagtcggccagccactggcccatggccggatcgcaggcccgacggtggaggatggcggtcagcgccccgatctggttggcccggccggcatgggcctgggccggcagcatgacctgctggtcccaacccagcaggcttagggcggcgatgatgtcggccgaggcccggctgtgggccaaaagggcgtcataagcttggcgggcggtcatttcttggcgctcctggccggagccttggctccggcggctttgcgggcggcgatcatgcgctcgtagaggggctgatagaaaaagctgacgtcgccttcgtttaagtcgcggtggtaggcgcagtagatgttgacctcgccgagctgccaggcgtggtagaacttgtcgcggttttcctgggtcggcggcccgtaggcgcgggtcaggccggccagggctttttcataggcggcctggccgtcgaagttgatccagacatggtagaactggtctttgaagaattcgtaataggcgtcgcggacgggcgcgccgaggatgtccttggggccttggggccagaggtaggtggcggtggcggactcggccgaggtctcgtactgggccatgcccgattgggaggcggcttgggcgccccaggtcaagccgccaaagccggtgggcgcgccgggggccagttccgtcggagcgagggaaacattcggggcggacgctgccggcggcgtggacggtggcatggcggcggccggcgctggcgcggccggtttgggcggttgcgccccgggcgcgccggggggcggcgtgggtttggctgcttgggcgctggctggtttcttggccggctggttgatgggcgtcccgccgctgacgggcttttcgccttgtttcggagcggtgcgggcggccggggaacaagcggcgagggcgatgacgagcaggatcgcggcgaggcgcggaaaaaagggcatgggacactccggacgagacggtcgatacgctgcggcaatgtagccaaagcgccggggaaaggaaagggacgcggcgtttattgttggggcggcggcgcgaagccgtaacgtccgagcgtcgccacgccttggggcgaggcgaggtagctgatgaaggcggcggccagcttgggctcggccgtcttggcggccacggcggccacgtaggtgacgggcgagggcaggggaaccggcgcggccacggccacggccttgccagccgaggcggcgtcggtggcgtagacaaagccggcgtcgatttcgtccttggccagggcggccaggacatggcgcaccgaggggtagtagaccagcttggaggtcagggcgaaccacagggccttttgctgcaaggcccgcttggcgtagcgtccggccggcacggattcggggttgccgacgccgatgcggcgcacgccgccgcgagacaggctgtcgagattgtccaccttggccggattgccggccggcacggccagcaccaggtcgtttagggccaccacccgcagcgtcgcgccatcgacccggcggcggtccacggccagggtcatggtttcggggtcggcgctgacgaatacgtcgtagggcacgcccgtgcccaggcgttcaagcagcgttcccgaggcggcgaattccatggcgagggtgtcgccgggatgggcggcctcgaagccggttttgcagtcggccagggcgttggtaaggctggcggcggcgaaaacggtgatggaaccggccgaggcagggagactggcggccaggatgaggaggagcgcggcgaacaggcgtttcatgcgggaaccccgggagtgctgtttgctacagcatagcccatggcggcccgaaacaaaagggccggccgggagcgcttcccggccggctcgctcagttcatgtgggcaacaaggggtctagtaccagtacttgagtcccagggccaccttccaggcgtcctggacgttgccggtgaagtcgcgggaggtggtgttccagacgctgcccttggggttgccgtaatgggcccagccggtttccatgaccagggccaggctcttgtcgtagatccagtacttggagtcgatgttgacgcccagcagatactcgccgatggccaagtccttgcccatggtcaggtacttgccattgccgccggaagcggtgacggccttgcgcaggccggcagcggagttggtgccccaggcggcggcgaaggtcacgacatggctgagcttgtcaattaacgagacgttgtccagggaggcggacagaccccaggaaccgatggggttggccagcatggtgtcgttggtgaattcctggccgctctggtacaaaaacgaaccgcccatgccccagtagttggcgatggtggggatgcgctcggaaccgttgcggatgctcgaatcctcgcccgagctccaccagcctccgatcatgggggtcatgaaggtcaggccggtgtacttgacgccgccgtcgatgaaccagccgtggcgctggttgcgctgccggtcgcccatggctccttcgccgtagatcacgtcgctgtaaaaacgtaccgggtcgagggcgtcgacctcgaacatggagccggcccaccagtagttggactggttctggttgtagcccgagggagacaggaagtagccgcccgagaccacgccgtacttgatggaatcaacggtcaggctggatttgccaaccacgctggccatggcccagggcgtggccttggagccttccagggtgatgggcagggtcaggaagaaggcgtcgaactcgtcgtccacctgggtggtggtggtgtcgtaggtgcgattggcgtcgataaggcgcgtgtagccgaggttggcggccagcgtgtccttgatcagcggcgccttgatggtcagggcggcgaaggtcttgttgttgttcttggaggccaggatgggcgaatcgtagaagatcgcggcatggggcagggagatgggctgcaggccggccgtcacctggatgtcggtgtcgggcaccttgaactggagataggcttcccagacagtgatggacacttccgggttggcggcggtgaaggttccggtaccctaggtctggtcgccgaccatggtggccaggcggaattttacggcctcgctggccacgaagtcggcgcgcaggcggaaacgttcccatatttcaaaggtgtcttcggtcttggtgccggtggcgttccaggaggtccagttgcggttctcgaagaacatgccgtagacacgggcgtcgccggccattttgacttccgtggccgcgttggctctggccacgcccagggcgagcaggcagcaggccagacagagcagggtctttcgcatcgatgcttctccgttgcgcgatggggttttctccgaaaaggacctggggacgatggttgtgtatgttacggttctgaaattgacaggacaacgaatccgtggttaggtaaaacaagccgagatgtcggctttgtctttttggataaagagccgccctggcggaccggggggcgaaattactcgtaaggtggagaattgcatggagatgaagatcaatctgcctgaggcggagatgccgacgcagtggtataacgccctgcccgatctgcccacgcccctggcgccgccccttgatcctcagaccaaggagcccgtgacccccgaacagctggaagtcatcttccccaaggccgtcatcgaacaggaaatgtcgccgcagcgttggctgcccattccccagccggtgcttgacgtctaccgcctctaccggcccaccccccttgtgcgcgccaagcgtctggaagaagctctcggggtcaagtgcaagatctattataaaaacgaatccgtttcgccggccggctcccacaagcccaacaccgccatcccccaggcctattacaacaaggccgaaggcgtgcgccggctggccaccgaaaccggggccggccagtggggcacggccctgtctttcgcctgttccatgctggacatggaatgcacggtctatatggtgaaggtgagctacgaccagaaaccgtatcggcgcatcctcatcaacgcctacggcggcgaagtctttgcctcgccctccccgcgcacccagaccggccgggccatgctcgaaagcgaccccgattgcaccggttcgctggggctggccatctccgaagccgtggaagacgccgccacccacgccgacaccaagtacgccctgggcagcgtgctcaaccacgtgctgcaccatcagaccatcatcggtcttgaagtcgagaagcaactggccatggtcggcgacaagccggattacctggtcggctgcgtgggcggcggcagcaacttcgccggcctggtcctgccgtttttgccgcgaaagctggccggcgaggccatcgagttcatcgccgtggagccgcaagcctgcccgaccctgaccaaggggcagttccgctacgactacggcgacgtggccaagctcacgcccctgctcaagatgcacaccctcggccacgccttcatgccggcccccatccatgccggcgggctgcgctaccacggcgacgcgcccatcgtgtgcaatctggccgccgaagggttggtgaacgcccaggcctactaccagaccgagtgtttcgaggcagccaagctgttcctgcgcaccgagggctttctgcccgcgccggagacctcccatgccatcaagggcgccatcgagaccgccaagaaggccaagcccggcgagtcggtggtgttcctctattccggccatggcctcctcgatctggcgtcctacgacgcctttttgcagggcaaactctccgacttcgcctatcccgaagagcatatcgccgaggctctcaaggcctgcccgaccgtcgggtaaagcgattcccgccgccgccctatacggcggcggggcttggcaagaacggcagcccgccggaccacggtccggcgggcttttttcatgcggctacgggatgttgatgatgacgctgaaggccttgaaggaaaaccacaccgtgtcgccttccttgaggtccaggctctccacggattcggcggtgataagcgcgcacatgggcgtgccgtcgaggagttcgcccatgatctccacagccacgccgtcgccccggatgcccgtgaccttgccggaaaaacagttgcgggcgctggtcttggccttgttttcgtccttggccagaagcacccacggggccttgaccagggcggtgaccggctcggcctcggacaggcccagacggtcgaagctctcgttggtgatgaccgccacgatctcctgattggtggtggtggtcatggaaatttccgtgaaaagcgggcttttacgcacgctcgaaacggctccgaaaaacgtgttgcgggcgctggtcttcatgcgggtctccttggcgacgcatcggctgacgatgcgttggcagtcggcgtcggaaaacgaacagtagatggaggtcaagaccacgctggaatggccgagcatcatctgcaccacgggcagggggacgccgctgcgcagcagctccacggcccgggagtggcgcaaggccgtggggctcacccgtcccggcggcagtccggcccgcttggcctgctcgtagagcttgcggcgcacgaaaccggggtcgaggcggaacagttccccccgcagggcccggttgatgggggccgacgcgaaacgctccacatcgtccaggaagtcgcgcggcatgacgaccttgcgggcggcctcgccttcgtggttggccggaaagcgcaccgtgcacttggtgcggtcgatgtccgtgcgttcgttgaccgccagcacctcgccgagcttggccccgcttaagcgcagcatggcgtagacaaggcgcatgcgctccctggcccggcggatcgacggcgtgcgggcggcgtcgcgccagacgacgaaggccttggtcagccggtcgagttcgtcggcgtcgagatagcggatgccggacggcacgctgaacaaggcggcctggcaggcggcggtcccgcgcggcgtatgccgggtcggggcgtcgagatccttgcgggccagggtcgcgccggcatgatcgcacagacgccgcagtgtggggacgtccagacgattgacgagatcgaatatggtttcttcagcggtggtcatggttgcattgtctagcgaagtggctatgcattgtaaagcatatgcgctttatatcacgaataataccctgtacgtgtcagtagttgtttggattctgcgttaactgtcacttgttttgtatttgccgtgtcgtctatttgctctatgacacgcaaagtagaaaagtcatgacgcttcactttttcgagaaatacggtatgccgcaggggtgaattggtccgcgacccgctgggcgagggccgggaagtcccaaaggaggcgtcatggcgacgtttgtctgcatccacggagcatttcagggcggttgggtctggcgggaggtcgccaaggccctggccgccctgggtcatgaggccttggccccgacattgtcgggctgcggccatctggcccacgcccaggggccggggctgggcttggctacctatgtcctcgacgtcgaacagtttttcgagcttgaggatcttgaggaggccatcctcgtcggccacagctactccgggatcgtctgcgccggggccttggcggggatcgccccgcgtctggccgggctgatctacgtcgatgccctgttgcccaaggccggcgacagttttaccggcatggccggcgagccgtttcgggccatgctggacgcccgggtgcgtgacggctggcaggtgctgccctgggacgcgcccctgttcggcgtggccggcgatgcccgggagtcctggttcctgtcgcggctgtttccattccccctggccgggttcaccgaccccacgccgggcgaagcgccggcctggccggccaagcgccactatgtgcgctgcgtcgccaaccccaatcccatgctggccgccaacgcggcccgggccgaagcggccgggttcgccatgcaggccatggacgccggccactgcccccagatcacggctccggtggagctggcccgggtgctggccgccatcgccgagaccattgtcgcggcctgacggcgcgtgtccggcaaggcgaggttgcgcgcgttgccggcgcgaagccctatgctgcattcgaggacgggacgcgagaaatgttgcacgccagggtcgtcaaacggctgccgcactttacccttgaagcggaaatccgctgcccggccgggtgcgtcacggtcctgaccgggccttcggggtcgggcaagagcaccttgctgcggctcttggccggcctcgacgacccggacgaaggcgtcatcggccttggcgacaccgtctggcgcgacacggcggccggggtgcggctgccggcccggcgacgcgacattggcctggtcttccaggagtattcgctctttccccacatgacgttggcccgaaacgtggcctatgccgccgtggacgccggctacgccgacgagctgttggcgctttttggcatcatccacctggccggggccaagccggcggccatgtccgggggcgaacgccagcgcggggccatttgtcaggccctggcccgccggccccgggcgctgctcctggacgaacccttctcggccctggacgcggccacccgtctggcccttcgcgcccagctcctgaaggtgcgggatcgcttcggcatccccatcgtccacgtcacccacgatctggctgaagcggcccagcttggcgacgccatcgtgtccatcaatcagggtcgcctggacccggactggttcgaccgccagctcgacgtccacctgcgggagcagggggcgctgctcgcccggcgcggcattgactgggccggcagcggccctgggcccatcggcaaggagggcggcgcgacgacggtggggcgtggcgaggagcggccggcccgcaagccgacgctggcatcgacggggggcgggagccttccaacgcccgggcgtccccgccgggaagaccaggctgtttgatgccgtggaaatgcggcccaggccgcgtcaaaccgtaaggagcaacgaacgatgcgacggattgcctgtctgtgcgcggtgttggccgcgacgctgtgcctggccgtttcggctttggcccaaaccttcaccgtggcggccggggccggctacaagaagccggtcaccgccctggccaaggccttcgaggcggccggcggcgtcaagaccgacctcatcttcggcaatatgggccagctcattccccaggccaagaccagcggggccatcgacgtgctggtgggcgagaagggctttttggaaggggccggcttgcggttcagcggagccgtgccgcttggtcgcggcgtgctggtggtggcctggcccaagggcatgaccctggccgcgccgggggacgtggccaagcccgagatcaagcgcctggccatggccgatccggccaaggccatctacggcaaggcggccacggaatatctgcagaaagccgggctggacaaggctgtggccgacaaactgctggtggtggccaccgttccccaggtgacgacctatgtccaaagcggcgaggtggatgccggattcgtcaaccgcaccgacgtcatggacctgggcgacgccatcggcggctatctggaaatcgacccgtccctctacgaccccatcgacctggccgccttgcccttggccgacgccaagaatacccaggccatcaaggctttcgccgctttcctggagactccccaagcccgggaaatcctcaagaagcacggtttgtaatgccgcgcatcggcatcggccttggggccgtccgacccttggcggcggcgcggacaaggcgctaccgcgctgcccgccgccggggggatcgggcatgatcccggcgacgcttgcggccacggccgccgacccggacgtgctgttctccatccggctcacgctgcgggtcatggccgtggccgtgccgctgtttttcctgcttggcgtgccgctgggctatgtacttggccggggccgggggcgcttggtggccgccctggacgtgaccgtgtcgctgcccttggtgttgccgcccatggccgtgggcttttttctcctgctgctccttggccgaaacggtcttttcggcgggccgttgggcaaaatcgccggtattgagatcatcttcggctttccgggattggtggtggcggcggtggtgtcggggctgccgcttatggtgcggccggtgcaggcggcggtgcggggcgacctcacgcggctcatggaactctcggctgtgctgggtaagtcttcggccgagaccttcgtgtgggtggtcctgccccattgccgccgcagcgtggccgccggtatgttcctggccgtggggagagccctgggcgaggtcggggtgagtttgctccttggcggcgacatcatcggccgcaccaacacggtgtcgctggaaatctacaacgccgtcttttcaggccagtacgaccgggccggttatctggccggactgctctgtctggtctccctggccctgacctggctgctcaagcggaccggccggggctaaggccgcctgacgcattcccgttgtttgctgttacgacatggtgacgccagagcttgacaatcattctcattgtcgttacttctcggacaacaaggagacaggcatggccccgtatggagcgctttccacttttccggccggtagccgcgtgcgcgtcgagacgttgtgcgactgtccccgggcgcgcggaaggctgtgcgccatgggcatcacgcccggcacggtggtggaaatcacttcctgctgcggcgggccggtctgtctgcgggccaggggcgcgtgcatgacgttggggcacggcttggccgaaaaggtgtacggccggctggacgccgtggccacggtctgaaaggccgggagaacgtcagcacatggagcaggaaacgatcatcggcatgcgccagttgcaggtcggccagaaggcccgcatcgtcagcgtgggcgcttcgggagagatgggacgccgcatccgcgacatggggctggtgcccggcacggaagtcgccatcatcggccgcgcgccgttgcgcgacccggtggcccttcgcctcaaggccttcaccctgaccctgcgcaacagcgaggctgaccacattaccgtgtcgccgctgtagggtttttcgacgtacacttgcgtcattggccggtcgcccttgggcggcctttttgttttcggccggggccgcctgcggcgtcttgcctgcgggataatgtcggggtatggcctgccggacggggacagggtcccggaaagggccgcatcccccgggaggaaaccatggcggaccaagatattgccggaaaggccggggagcattttgccgccggctgcaactgcgcccaggcggtgttacgctgctttgccgaccagtatggcctcgacgccgacacggccgtgcgtctggccacggggtttggcgtgggcatggggcgcggcggggcctgcggcgcggtttccggcgcggtgatggtgctggggttggccgggggcggcggcgggccggacggcgcggcggccaaggccgccacctatgcccgggctcgggaattttacgaccgctttctggaacgccatgggtcgcttatctgccgcgacctcatggagcttgatccttcgacccccgacggcctggagcaggcccggcgcgaagggcgttttaccgcccggtgcagccgctatgtgggcgacgccgccgccattgtctcggccatgatcgagagcctgccgccgcgcgtctgacgcccgaggacttcatcttccattacggctcaagcggggcatgaacaatcgaaaaagcccccgcgttgccttggcagcgcgggggctttgtgattgtgcgaaacgaccgacctagaagcgttcgaagtcgctgtcgtcggcgtcattgcccagattcgccttggtggcagcagggcgggcaggccgaatgaccggacgggacgacttgcggccggaggccagggccttgggggcgctgggtcggcgggtcatggtgtcaaggcggaagtaagccacggtgtcctggagctgcagggcctggctcgacagttcctgggcggtggaagccatttcctcggaggccgaagcgttttgctgcacgacctgatcgagctgctggatggcccggttgacctgctcggctccggaattttgctccacgcttgaggccgtgatttcctggatgagttcggtggtgcgctggatgtccggcacgatgcgggccagcagttcgccggccttttcggcgatctgcacgctggacgaggacagttcgctgatttccccggccgcgttgccgctgcgttcggccagcttgcgcacttcggccgcgaccacggcgaagcccttgccgtgctcgccggcccgggccgcctcgatggcggcattaagggccagcaggttggtctggcgggcgatttcctcgatgatgccgattttttcggcgatctgcttcatggcgcccacggtcttggccacggcttcgccgccgttttgggcgtcggaggcggtcttgagcgccatctgttcggtctgcttggcgttgtcggcgttctggcggatattggcggccatttcttccatggacgaagagatttcttcgacgctggccgcctgttcggtggcgccctgggacaggctctgggtggtggccgaaagctcttcggaacccgaggccacgttttccgccccggactgcacctggccgaccacttcgcgcagcttttcgatcatgtggcgcagggccttggccagatcgccgatctcgtctttctggtcgatctcgatgcgctggttgaggtcgccggcagccaggccttcggcggcgcgcacgcccaggagaatgggacgcgtgatcatgcgagagatgacgatgcccaggagcagcgccatcaccacgccaaagccgatgccgacgatggcgatcatcctggccttggcggcggcggcttcgccttcggcctggctcttttcggcgtcggccacggatagggtcatgagccggtcaaggagctcgaagcagcggatctgcttgtcgcgcaccgtgaccatggcgtcctggcgcatccgggcatagatttcctcgacacgccccacttcgtcggccatgagattgaactgggccacggtctgttccacgggttcgtggatatccgtgcggacaagggtcagcatctcttctttgggagcgtttttggcggccatttccttgaggcgggccacgccgcgatgcagtttttcgtgcacttggcgcaaatcctggatagcctttttgaagaccgggttattgatgttgcgcccggtcgaggccatccattgcccgaaattgcactgctcggggttgtcgccgccggccaggggcttgccggacaaggctaggccgtaggcgtcgtcgagcagtttgtagtggtcgccgcgaaataaatagatcttctggcgcaggaccgcagggtcgtctatatcggtcttgtcccactgtttggccagctcgaaggtttcgttgttgattttgacccattcctgccaggccgggccgaattcccgccacaggcgttcggcttcgggggatttgggtagtttatcatattcatcccaggacttgcggtaggtgtcgcgcacccgggcgatattttcatactgccgatcccggtctttctggtcgagtccgggaatgagcaggctgcgctgcgccacccggacggtctcgccggcgatcttgatcagctgcagatcgcgcacggtgggcaggctgacgtcggtgacggtttgcaggtggctggtcacattggacagacccgacaagccgaccagaccgacaataagggtgatggccgccgtgacgagaaaaccgccgaccagtttgaccccgagcttcaagttgcgcatgtaacaatctcctgcggttccgtcttgcttgttgccgtatcgacgaaacaagacatttccctaagggggcgcgggaagatttgtcaaacggttcggcttggctcgggggcgggcgttccattgtcggccgccagcctgccgtcggcgatttccaccagacgaccggccatgcgggcgtagagcggttcgtgggtgaccagcaccacggtgaggccttccttgttgaggtccgacaggatgtccatgatctgacggccggtgccgccgtccaagctgccggtgggttcgtcggcgaaaagggcccggggccgggtgaccagggcccgggcgatggccacccgctgttgttcgccgccggagaggttgcccggcaggcgctcagccttgtcggcaaggccgacccgctccaggcattccagggcaaaggctttgcgcgcggcgtccaccggccgccaacccgagagaaagggggttagcacgttttcgaaggcggtgaggtaggggagcaggtggtgcatctggaagaccatggagaagtccgtggcccgcagtttgtcgcgctcccgggcggacagggcggccaggtcgcggccttcgtagagcacctgaccgctgtccggggtgagcaggctggagaggatgttgagcagggtggatttgcccgagcctgaccggccgaccacagccacgaattcgccggccgtgacggaaagcgacacgccgcgcagggccggggcgttgccggtctcgccggcgaaagtcttgacgatgtccttggcgactagcattagtgttttccttgatggggggtccgggggcctcaggcccccggccgccggaggctcttgcttttgggctacaacatcaccagcgcctgggacggctcgatgcgggaggcggccagggccgggggcagcgaggccaggctggtcagggcggccacgcccacgaacaccagggcgaactgcaggggatcgaatgtgggcgcggcctgttcgcccaggtcaagtagcgccatgagccggccgctggcggcaaagcctgccgcctggccgatgaccgccgccgtggccccgaggagcagcgcctccagatgcatgagcaggaacaccgaacccttggagaatcccagggcccgcagcaggccgatctcgtttttgcgctcgttgaccgaggagaagatcgacaggccgatcatgacgcaggccgtgagcaggatgacgccggacacggcaaaggccagatgtttgacgaaatccacggtcatcatccggcttttgaccacctgttgcatggccttgacctcggctccgggcagatttgcgccgatttgggccgtgatctcctcgatggggcagccggcgcacagggccgccacttcgacgaagtggatgcggttgaccttgccggcggcggcctgcaaggcgtggagatcggcgaaaaggagcttgtcgtcctcggagccggtggggccaaggacgccggccacggtgaagtcgcgcccttccagggtcacgacggaccccggggcgaggttcaggcgggccgccgcctcgctgccggccagcaggccgaaggaatccagggagagcgtgccggcttcggtgaaccagtggcttttgatctggcgttcctgctcgaaatccacgccgatgacgccgaccggcgtgtcggccacccgggccagcagcacgaactttggggccacggcgcttaagcggtccttgtggtggataccggaaatggcggccagggtctcgtcttccttgaaatacttgatgtccaccgagacgtcgcccagggccatgccgccgtagcccaccgacagcgtttcggtttttgggctgaccaggatgttggccccgtaggcggcgagcttggattccaggctctcgcccacggccttggacaattcgaccagggccgtcaccgaggccacgcccacggcgaagaccacggccgtcagcaggcttcttgccagtttacggcgtaaattgcgcagcggaatggtcaggatgttcacggttcctcgctgggtgtggtgttgccggcggcccatggccgtttggttgcgggaacgttcccccaatgcgcgccgggccgagtgtcgcgtctaggaaaagcgcttagggcgtttcgcggacaacaggctatcaccattattttcttcaaaatacttccgtatttttgaagggccgtgccgtctagaagtaagccgctccggcggcgagatcggccattttgatgcgcacggattcgcctgcgacctccgaggccaggggcgaagggttgcagccgccgcgctggtcgcccaccatgttcatgtggaagcgccggccgcagttgatgcagagcatgaagtcgccttcctgacggtagccttttttctcgggataacacacgtcgcaggcgtccagggcggtgcgcacccggccgtccttggttttgacggcgaaaaagcgcacttccttgccggcggcgtccacagcgtaaaagtgggccttgccgtcggttagatcggccactggaaaggaaacgacgccatcggccggcttgaggctggtcgggccggacgaaaagccaagcagggcatggccggggccggcggcgacaaacagaacggccagacaggccagagctacgggcagcaggcgtttgggggcggagaagggcatagggggttcctttggctgacaagcgtagtgggggagccggaaaaggctacaagtgcggtcggaatttaagcaatgcccgtgccaggggtgggccgtcccgaccgctgtctagcccggttcggccggaagtcgtgtttggaacgggggatgcagacgttggggacagacgccggccggcagcttggccattgcccaggcgtcgcttttctagacagtagccccttaggtgtgtatagaatgtatgcaacatggctgttttctatccaggcgcttccgagcgctgcccaggcgggtccgtgcgccagataatcaagcgctggtcgtttcgcggcggcgcgtcgcctttgctgctgcttggcgcggccggcatcctggccgccgtggtggcggccatggcggccatggacctgggccgcgaaaagcaatacatgacccagcttttgctggaaaaaggcgcggcgctcatcaaggctttcgaggccggggcgcgcaccgggatgcggggcggctttggcgcggacatccggctgcagcatctcatcgaggaaaccgccaaccagcccggcatcttcgccatcgccgtcaccgacgaggacgggcgcatcctggcccacagcgatgcctcgcgcatcggccaggcgcttttcgatccgccggtcatggccgagctggccccggacgccgccgagaaatggcggctggccgtggaggaagaggccgggcgcgagtcgtttttggtctaccggcgcttcgtgccttcctccgccggccgaggcccccacgggctgcgcgcccatccaccggttggcgagcgggagtttctgtgcaccgaggactgcgacgccaagggcgtgcgccggcccctgcgcggcgtgccgctcattattttcgtcgccctggacgtggcccccatcgaggctgcacggcgggccgatctgcacaacatgctgacctcggcctcggtcatcctcattgtgggcctgggcggcgtgctcgggcttttctgggcccagagctaccgggcccagcgcaaggccctgcgccagaccacggccctggcctcggaagtggtggcggccatgccggcgggactgatcctcatcggccccgacgataaggtggccatggccaacggcgcggccgaacagttggccggcgtcgctccgggcgggctggtcggccgcgaagccgcctcggtcctgccctgggaagaggtgcgccggccggccgccgacgagcgcgagatggacatgtccctggccggcggcccggtggtcgccctgggcgtatcggtctcggccgtgcgcaccgaggagggcacgccggtggggtcgcttgtggtgctgcgcgacctgcgcgaggtgcgccggctggaagccgaggtgcgccgccgcgaaaagctcgccgccgtgggcaacttggctgctggcgtggctcatgagatccgcaatccgctcagttccatccggggctacgccgcctacttcggcggcaagttcgaccccggcagcgaggaccggcaggccgccgagatcatggtgcgcgaggtggaccggcttaaccgcgtcatctcggaactcattgaattctcccgaccctcggacatccagcgccggccggtgcgtctggccgatctggccggccacgccgcccgcctcatccgccccgacgctcttgcccggggtgtggagatcgccgtcgaggacgcgccgggcgtgcccgacgttccggctgatcccgaccggctggcccaggcggtgctcaacctgtgcttaaacgccgtccaggccatggacgcgggcggcacgctcggcctgcgtaccgggctggccccggacggccgggcctatctggaagtcacggataccggccggggcatcgacccggccgagcgcgaccggattttcgatccctattatacgaccaaggcccggggcacgggcctgggcctgcccatcgcccacaagatcgtggccgcccacggcggcgagatacggctgacgccgcgccccgagggcggcacctcggccatggtgctgctgccggtcacgggcggcgagggggccgatacggaggaagccgatgcgggctgaattgctggtcgttgacgacgacgccgggcacttgtccatgctgcgcacggtgctcaccggctggggctacggcgtcaccggggcaacggacggggccgaggccgtggaactggtgcgaagccgtcccttcgacgcggtgctgctggacgtgcgcatggccggcatgggcggcatggaagccttatcactcataaaagagtataacccggccgtgccggtgctcatcatgacggcctattcgtcggtggagacggccgtttcggcgctcaagtccggggcctacgactatctcaccaagccgctggacctcgacgtcatgcggctgaccgtggaacgcgccctggaccatctgcgtctggcccgggaaaacgagaacctgcgccaaaagctcgggcctggcgtggtcgggccggagatcatcggcaaaagcccggccatgcgcgaactgttttccatgatcgccatggtggcccccaccgaggccacggtgctggtcaccggcgaatccggcacgggcaaggagctggtggccaaggcgctgcatgccggcagcccgcgcgccggcgggccgatggtggccgtcaactgcgcggctttaaatgaaaccctgctggaatcggaactcttcggccacgagaaaggggccttcaccggggccgaacggcggcgggaagggcggttcatggccgccgacaagggctcgatctttttggacgagatcggcgaaatcgccccgtccatccaggccaagctgttgcgcgtcatccaggagcgcgagatccagcgcgtgggcggcgaccggccggtgggcgtggacgtgcgcatcctggccgccaccaaccgcgacctcaaaaaggaggtcgaggccggccggttccgcgaagacctctactatcgcctcaatgtcgtggccatttccgtgccgcccttgcgtgagcggggccaggacattccgcttctggcccagcatttcctgacccgctttgccgagaaaaaccgcaaacgcatcaagggcttcaccccggcggccatggaccacctgctgcgttgtccctggccgggcaacgtgcgggagctggaaaacgccgtggagcgcgccgtcatcctgtccgtcggggaatacgtcaccgagcgcgaactgccgctgtcggccatgcgcgaggccggcggcaacggggccccaggcggagcaggcggaggcgcgcccgcgccgggcgacatggccggactggccggcatggccctggacgatgtggagcgcgaggtcatcctggccaccctgcgcgacaccggcggcaacaagagcgaagcggcccgggtgctcggcatcacccgggccaccctgcacaagaagctcaagaagtacggcgaggaatagggggctttcgccgcccgggtcgagacaggaggcggggtcggcagcctgtctcctaatccaatacgacgcgtgccagccgcccgggccgcgccggcgggcaggactggcagcccgtttcctgatccgagaccaaacgtggccgtcgctcgccaacgaaactgggatggtttcccggcccgccgccacgcccgacaataaaagggcgcggactggtccgcgccccggtaacttgactttatccgtcgggagaaaaccctcccgccccttgtcctaccgcatggcctcgggaaagagcttgcccgccagctcgcgcagcttgtacttctgcaccttgccgctggtggtcagcggaaactcctccacgaacgcgatgtacttgggaatcttgtgccaggcgatctggccccggcagaagtccttgacgtcctcgggagccatctccacgtccttgcgcaggataataaacgcccccacttcctcgccgtacttgcggctgggcacgccggccacctgcacgtcggcgatgcccggcatggtgtagaggaattcctcgatctctcgggggtagatgttctcgccgccgcgaatgatcatgtccttgatgcgaccggtgatgaccacgaagccgttttcgtccatgacgccaagatcgcccgaatgcagccagccgtccgcgtcgatgcacttggccgtggcttcgggattcttgtagtagcccttcatggcgttgtagccccggcagcagacttcgccctgcttgccgcgctccacttcttcattggtctcggggtcgagcaccttgacttcgacgtgggggaaggccttgcccacgctttccacccggtagtggtaggggtcgtccacgtcggactgggtcatgccgggcgagctttcggtcaggtcgtagacgctggtgatctgcttcatgtacatcttctcggtcacctgccgcatggtctgcaccgggcagaccgagccggccatgatgccggtgcgaagggacgagaagtcgaatttcgggaacagcggatgctccagcatggcgataaacatggtgggcacgccgtaaacggccgtgcacttctcctgctcgatggacatcatggatttgaccgggtcgaaaacttcggtgaaaaccatggtggtgccgtggttgaggcaggccatgacgccgagcacgcagccgaagcagtgaaacagcggcacgtggatgagcagcttgtccttattggtgaaccgctggcgctggccgatagagtagccgttgttcaggatgttgtggtggctcagcatgacgcccttggggaagccggttgtccccgaggtgtactgcatgttgaccacgtcgtggcagttgaaggtggcctgccgggctttcaattcctcgtcggtgacggtgcgggccagaccgatgatctcggggatggagtacatgccccggtgtttttccacgcccaggaagcacacccgcttgaggtgggggaaagtctcgcttctgatcgccccacgctgcatgttgcgcagctccggggccaggtcgtagaggatctcgatatagtccgaatcccggaagccgttgatgatgaagatgttgtcggcgtcggaattggtgagcagatacttgagctcgttgcgcttgtaggccgtgttgacggtgagcagcacggcgcccatcttggccgtggcgaacatcaacgccacccagaagggcacgttggtggcccatacggccactttctcgcccttttggatgcccagggccatgaggcccttggccagttcgtcggtgagttcgtcgaactgctgccaggtgagacggtagtcccggtccacgtagaccacggcgtcctggtccgggaacttggacgcggtttccttgagcagttctcccagggtcaggtcgcgaaggggcggcacgaaggtcatgggcggctcctttgcctactgcgggatgtaaaggacagcgtagatgtcggtcttgggcgcgttgccgcagcccacgtagtggggcaccaccgaattgaagtagaccgagtcgccggccccaaggacatggcggtccgggccgacgatgacttccagctctccggaaaccaccacgatgaattcctcgccctcgtgggaggacaggggcttttcggccgccgcttcctcgtcggggtagatctcgatgaaaaaaggctccatgtggcggtcggtcttggccgcgcccagggaatggtatttgtagctggcccgcttgccccgggccttgcgcagtatggcgtcgtcagccccgcgctcggcgcagcaggtcaggcagatgtcgctgtccacggcgtcgtccatgaaggtgcccagacgctgtcccagggccagggcgatcttgagcaggggaccgatggacggggttacgtcctcttcctccagggcggtgaggaattccacggaaagaccggtgcggcgcgacagttcctcgcgcgacatttcctgccgttcccggtacgtgcggatgcgatcaccaagctttttgacgctcatggctacctcgtggctgatatgatgggacggggcgagagtcgacgtgccccaggaaggtggcccaataccatactgctgcgcggaattccagccgtttttcccgatctcgccgctcggaaagaaccgtttgacaagccgggcttccatgcgaaaagacgggagcaaccatttcgctaaccatacgagccaaggggtaccccatgagcaaggagatcggaccggtccgggagatcgccatgcgccttcgcggcctgcgcgaggcgaccggcatgacggcccaggccctggccgaggccaccggcgtcacagccgccgacgtcgcggcctacgagaccggcaacaaggaaattcccgtcagctacctctacgaggtcgccaaggcctgcggcgcggacctgaccgcgctgttaaccggcgacgatgcccacctcatgaattattccctggtgccgtccggccaggggctgtccgtggaccggcgcaaggcctacaagtaccaggctttggcctaccgtttccacaagccccacatggagccgttcatcgtcaccgtgccgcccaaggccgagtccgagatggaatttaaccgccacctgggcgaggaattcatctacatgctgcgcggccggctggaagtgcgcctgggcgaggacgtcgtggtccttgaaccccacgacagcctgtatttttcctcccgcaccccccacgccatgcgcggcctcgacggtgaaccggccgagtttttggacgtcattatctagccgggccgccatgccgtcccggcgggcagcctggccgaattgacctgtgccggagtgcatcgacaagacaacaaccgttttgcccgggagtccaagaccatgcctgtcgccaaactgcgacccaaatcctaccgtgagctgctcgagacattttccatcgctgtgcccgagaactataatttcgccttcgattttctcgacgccgaggccgcccaggacccgacccggccggccatgatccacatcggcccggacggaacccggcgcgatcttgatctggcctatttcagcaaggaatcggcccgcatggccaatgccttcaaggccgcgggactcgccaagggcgacaaggtgatgatcatcctctaccgccgggtggagtggtgggtcaccatgctggccctgcacaagctcggggccgtgcccgtgccctcgcccaacctgctcaccccccacgacatcgatttccgggtcaactacgccggcatcaaggccgtggtggccgaggattccgtggtcgaccgggtggaagcggcccgggccgcctgcccgaccctgaccgtgtgcgtccaggtcggcgcgtctccgctgccggccggctggctcgactacgaaaccatccgcgccgccgccgccgaggatttcccccgcaccgccgaggccccgggcggcgacgattcgctgctcatcttcttctcctccggcaccaccggcatgcccaagatggtggagcacagccacgcctatcccctgggccacctcaccaccggcgtctactggcacaacctggagcccggcgacgtccacctcaccctggccgacaccggctggggcaaggccgtgtggggcaagttctacggccagtggatggccggagccacggtcttcacctgggatttccggggcaagttcgtgccctccgagcttctcgacgtcatgaccgcccacaaggtgacctccttttgcgccccgcccacggtctaccggttcctcatccgcgaggacctcaagaagtacgacctctcggcgctgcgctactgcaccaccgccggcgaactcttaaacgacggcgtgttccgggcctggaaggaaatcaccggcctttccatctacgaaggctacggccagaccgaaacctgcctgcaactggccactttcccctgcatgacgcccaaacccggctccatcggccggcctaccccgggctggaacgtggtcatcctcgacgaggaaggcaaaccctgcccggccggggtggagggcgaaatctgcctcaagctcgaagacggcaagaacctgggcctgttcaccggctacctccaggaaccggccaaaaccgccagcgtcatggtcgacggctactaccataccggcgacaaggcttggatggacgaagacgggtacttctggttcctgggccgcaccgacgacctcatcaagtccagcggctaccgcatcggacccttcgaggtcgaaagcgcgctcatcacccacaaggccgtggtcgaggccgccgtcaccggcgtgcccgatcccgtgcgcggccaggccgtcaaggccacggtcgtcctggctcccggttacaccggctccccggaattggccaaggaactgcaagagcacgtgaaaaaggaaaccgcgccctacaagtacccgcgcatcattgatttcgtcgccgagctgcccaagaccatcagcggcaagatcaaacgcgccgagatccgcgccaaggacgaaagtcgggaaatataaggcgaagggaagaggaagatgccttgtatgtttccccatcgaggttagcttgatggggtcaaggggacgataggtcgaaattgccttgagttttaagctcgagccggagccatgatcgtcgtccccttcttccatgaagcccgaaccgttgcttgggctaagagcccgtatcacaaggctgggtactggaggaatgtacatggctgctgactgtttcatcggaattgatgtctctaaggaaactcttgctgtccacacgcttcctgacggaaatgactttcaatttgttaacgaccccgatggtataaaagctatctgcaggaaattttcaaaatttcgtccaaagcttattatcatcgaggcgactggcggccttcaaattcctgttgccacggcattgagtctcaagaaattccccgttgtagtcatcaatccccgccaggctcgggattttgcgcgagctaaaggacggctggctaaaacagacaagattgacgctgagattcttgctctttttggcaagcagatggagcctgaagtacgccctctgaaggacgagcaagcgcaagaaatgagttcgctaatgtccaggcgcaaccaactcattcgaatgcttgtcatggaaaaaaatcgttttactcgtgcttatggctcggtaagagcagatatagagaagaatattgactggcttgaggaacgattgtctgagatcgacacgcatcttggcacagtagtacgagcgagtccgatttggcgtgagcgagacaatttgctccggagcgtccctggagtcggagatgtcctatcaaggtcgctcctttccaatctgcctgagcttggaacgttgaatcgtcgggagatcgctgctcttgttggggttgcccctttgaattgtgacagcggaaagcgtcgaggaaaacgtcgtgtatggggaggtcgaagtgatgttcgatctgtattatatatggctgtcttgtcagctaaaaaatacaatcccgtcatacgtgatttttacaatcgcctcaaggaagccggcaaaccacataaagtcgccgcagttgcttcgatgcgaaagttgataacgattttgaatgcaatggtgcgatccgggcaaccgtggggacagtacgcacacgcggcgtagatccctgattatcggttgactcagaacaccgttgctccggcggccgggagggggttaccccctcccggaccctccctgtttggggtcggcgtttccccgggcttcaggcggagcctgaagcccggggaaacgccgaccccaaacgggaaggcttcgcgaagcgcgcggagaccgcaaaccatatgggggggccgggggcactcttctctcctgctcccctggagaccgcatggaacgagcccgcctgtacgtctttgccgccgtgtttttcggggtggtgctcatcggcaccctggggttcatgcgggtggaaggcctgaccgccctggacgccttgtatttcagcgtcgtcaccgtggccacggtcggctacggcgacatccacccggtcacgcccatgggcaagttgctggccatggcgctcattctttccggcggtggcacgttcttcggcatcctggcggcggcggccgagatgtttttgggacggcgggaaaaacggcttcgggctgaaaagcttgacatgctcatcgggctttttttcagccaggtcggttccaccctggtgcgtcggctcatccgggccgacgccggggcctcggccctgcgggaaagctgcgacgtctcgctgcgctggaccaaggaaaacttcaagaaagccgaagggattctcaagaactaccattacgatctcgatatggccgccatcgacctgcctgccatgggcaagctgttggccgccaattccgaatttctcgtgcgtctgctggagcaccccaacatcctggagcacgagaccttcacctcgctcttgcaggctgttttccacctcaaggaagaattggcccatcgccccaagctcgacgcgctgccggactgcgaccgggagcatctgcgtttggacttaaggcgcatctattcccagatcctcctgcaatggctccattatctcgaccacatcaaggacaactacccgtatttcttttccttccaatgtcgggtcacgccgtttctggccagtgaagacgccaccgtgtgcacctaggcgattctggtcctcgtttttcgcgacaccccttgccaaagcttcccaagccgggccatctggcggccatgcgaatggatgtttcgtcggggctttgggcgcgggcgctgcgcgagccgttgacccattttctggtgcttggcgcattgctttttgccctggggacgtatggccggccgtccgggccgacagccgttgtcgagggcgcggccatcgtcgtaacagacgaggatgtgcgccagttggccgggctgtggcggatgcagtggggccgggagccgacgcccgccgaactgcgccggctggccgacgagcaggtgcgcgaggaagtgctcgtgcgcgaggccctggccgccggcctggaggcccaggacatcctggtccgccgccggttggccgccctggccgccgcccggctggagcaggggatcagcctgcccgagcccagcgaggccgaactgcgcgccctgtacgaggccgatccggtcgcctttgcgccggtcgccgagctgaccttccgccagagcgcctattccgaccgcgcccggggtggccgggccaaggaagaggccatccaggcccgcgatgcgctctccggccagaatgccgccgccggccagggcctgggcgatcacaccgaactgcccgagcgctccgaaaacgtgaccccggccgaggcggcggctcttttcggcgacgccttcgccgccgcgctcaccaccttgccggtcggttcctggcaggggccgctggccaccctgggcgactggcatctggtctttgtcgaagcggcccggcgtggcccgccgccgcctttcgaggcggctcggccggctgtggccgaggcctggaagcgcggtcgcctggaagccgagcggcggcaagcctacgcggccgcgctggcccgttatacggtcctgctgccgccgtccgtggccggggaccggccatgacgcgacatcttatcgcactggccgttgccgccgtcgtcctggctggcctgctggccgcgccgactcccgcccacgcccacgagacccggccggccgtgctggaactgcgccagaccgctcccgaacgctttgacgtgttgtggcgcacgccgctctatgaaggccaacgtctgccctttgtcctgcgtctgcccgacggcgcgaagcaaataagcccgcccatcgtcatgagcctgccggactggcatctggaatcctggcgcatcgccgcgccgggcgggttggtgggcaagcgcatcctattttccggccacgacgccaccacggccggggtggtggtgcgctatttcgggctggacggccgggagtcctcggccgtggtcaccccggacaaggacggcctgaccctggccggccagggctcggccggcgcggacttcaccgatgccgtggccctgggcctgcgccacatcggctacggcatcgaccatctgctctttgtgctgggcttggtctgtctggcccggggcggctggcggctggtggagacggtgacggcttttaccgtggcccacagcctgaccctggccgccgccgccttggggtgggtcagcctgcgcgccgagccggtcaacgccgtggtggcgctcagcatccttttccttggcccggagatggtgcggcagctgcgcggccagtcgagtctggccatccgtcggccggcggcggtggcctttgccttcggcctgctccacggcctgggttttgccggcggcttgtccgggtttggactttcccgggaggccctgattgcgactctgctcggcttcaacctcggcgtggaaatcggccaactcgcctttgtggccgccctcctggccgtggccgcctcctttgcccggctgggcatgtcctggccggcctgggccggctatgctcctgcctatgtggtcggcacggccggggcctacctcaccatcgcccgaaccgccgtcatgttggatatatgatgccgtcacgcgctattgccgccggtctggccgttttgacgttcctgcttggccgggccgagccggccctggcccatctggtcagcgccgacgtgggcgatttctacgccggcctgctccatcccctgacctcctgggagcatttgctccccctggccgggctggcctttctggctgcccagtccgggcgcggcggcggccggctggccgtttgcctgcttcccctggccctggttgtcggcgtctgcggcggcgcgctctggccgctgccccgggccgccgccggactggccggactttggctggccgtttgcggcgtgttggccgcatggcccgggccttgccgtcccgccctggtcggcctgtgcgccgccggcctcggcgtggctctgggctggcgcggcggggcggactgggccgtctcccgggccggctggcagttcgtgccgggcgttgcggcctgcggctttttgctgacggccctgggcgcggcctggctgccgcgcctggagggcggctggcgggggaaggcgcgtggggcgctgggtctggccttgacactggccggcctgctgctggcttttcgcggcgtcatgggagagggcggcgcggccggcctggggcagttcgccggctggctggacggcggacgggtgggcgatttcctcaagcagcccaccgcctcgccctggaccctggccggtgtcctggccggggccatggcctggggcggggttcatgccctcactcccggccacggcaaggccctggtcggggcctatctggtcggcgcgcggggcacttggcgtcatgccgtctggctgggactgaccgtggccgtcacccatacggcgggcgtttttcttctgggcggcgcggccgtgctggccgccgacgaggcgggacgggagcggatgcttccctggctggccctggcctcgggcctgggcatgtgcgccgtgggcgggaccatggccgcgcgcggcctctggcggcttagcggccgggcaggggaggagcgggcgcacagccatgggggcctgactcacagccatggcggcttgccccattcccacggaggaacgtcccatagccacggcggcgtcgcaggcggacaagacgaggcgctgcacaaccacggcgggccggcccacagccatggaggagggacgtacagccaggtcggcggaacctccgaaccggtcggctggcgcaatttgctggccctgggcgtggccggcgggttggtcccgtgcccgtcggccctggccctgatgctggccgccatcgccctggggcggccggggttggggctggtgctgtgcgcggcctttggtctggggttggccggcgtgctgaccggagtgggccttttgtgtctggccggggtgcggtttctgggcgactcgggccggctgggccgggcggcgcattggctgcccctggtcggggccgggcttatcgccgccatcggcgcgctggccgcctgggaagcgctggccgtgctcatttcctgaaaaagggccgtccgggcggttgccagccgccgtggcccggactatggaaggcgaaattccgggccgcgcggcaagagccaccggccgcttccgcgaggacccatgcgccagggcgacgccgccaaaaccgtatcccccatcgaagccgttcgccgctactgcctgaccgcctgcatgggcggccagcgcagcttggtcgccggctgcgtcgatgccgactgtccgttccatccgctgcgcttaaaggaagtgcccgagggcttcggcgtgcgtgtggtgcgggtcatccgccgcttctgcctgcgctgcaccctgggtgatcgcggcgacatccgccgttgccgggaaaaggccgcctgcccggtctggccttaccgcatcggcgtctcgccccgaaagctcaagcgcctcatcgccgaaaaacgccgccccaagcagctcgaactgccgctctagcgtcgcgtcccttaaaaagtacgagagtattttttaagaaaacgcagggttgtcgtttgttgcctgcgaaacgccataggcgcttttcgcggacgcgacacgagcttcaccccgcccggtccgcctggagcctcatggcgcgattttgcccgccttttgtcgtgggcgtctttcgccctggcctcgcccgttgccgccgtctccgcttctcgaccgtccgtcccggccaacggtagtcccgcgccggtaaacggcgttttcccgttttcccgccgccgtccgcccgccatggggccaatcccgccgtccgccgaaattcccgtgccgccttgtcgcgggccgcctatttgtggcccatccccaagcggcggccgtcgccgacgggacgcccggaccaaccccggcccggccacaggccggagacaaggagcacgatccatgcaaccagaccacgccccgcccgccgcccacgccccggacgccggccagttttccgccctcgtgcgcaaacgctggaccgtctccctgaccctgaccgcgctcatgctgtccatttactacggcttcatcatcatcctggcctttcgccccgacatcttcgccgaacgcgtcggccagcgcctgacgctcggcatcccggtgggccttggcgtcatcctggcctcctggctgctcaccggcctgtacgtgcgctgggccaacgacgactacgacagcaccgtgaacaccatcaaacgcgccatgcgggagaaccagggatgaacacgtttaccagcaccatcggccagcccaacgccacctccatcatcttcttcttcgtcttcatcgccgccaccctggtcatcacctattacgccgcccggcgcagccgctcggcctcccagttctacgccgccggccgctcggtgaccggctggcaaaacggcctggcgctggccggcgactacatgtccgccgcctcgtttctgggcatcgccggcctggtgtcgctcaagggctacgacggcctcatctattccatcggctttctggtcggctggcccatcatcatgtttctcatcgccgaacccctgcgcaacctcggcaaatacacctttgccgacgtggtggcctaccgtctttcccaaaaacccgtccgcgtggccgcttcgatcggctcgcttttgaccgtgtgcttctacctcatcgcccaaatggtgggctcggggtcacttatcaagatgatgttcggcctgccctatgagacggccatcatcattgtgggcgcggtcatgatcgcctacgtgctcttcggcgggatgctcgccaccacctgggtgcagatcatcaaggccgtgctgcttctggccggagccacggtcatggtgctcatggccctgtcccggttcaacttcgacgtgacggcgcttttcggcgcggcggccgccacctacggtgagaaagtgctcaatcccggcgggctggtggccaatcccctggacgccgtgtcccttggcatcgcgctcatgttcggcaccgccgggctgccccacatccttatgcgcttctacaccgtgcccgacgccaaggccgcccgcaaatccgtgttctacgccaccgggcttatcggctacttctacatcctcaccttcatcatcggttttgcctccatggtgctcgtgggccgcgacgtcatcgtcaagatggacgccggcggcaacatggccgcgctgctcctggccgaagtgaccggcggcacggtgtttctcgggttcatcgcggcggtcgccttcgccaccatcctggccgtggtggccggactgaccctggccggagccacgacgctgtcccacgacctctacgccaacgtgtttagggccggccgctccaccgaggaaaacgagatgaaggtggccaagcgggcgaccatcggccttggcgtggccgccgtcctgcttggcctggccttcaagggccaaaacgtggccttcatggtgggcttggcctttgccatcgccgccagcgccaacttcccggcgctcatcctctccatcctctggaaggggaccagcaccttcggcgccacggccagcatcgtggccggggccgtggccgccgtggggctcattgtcctgtcgcccacggtctgggtggacatcctcggcaacgccgcccccatcttcccctggaagaacccggccctggtgtccatgccctttgccttcctggtcggctggctcggttcggtgctggttcccgacgcccgggcccagtccctctacgccgcccagcagatccgcaactatctgggcgtgggcgcggagtgatcgctcgcaaacggaccggggaggctctccccggtccgttttgccgtttgtcgccgtgtttcggagatgccatggacccacatgccgccgcccttgtcgccgctttgtccgccgcccccgacagcctggccctggggcgggaactggagcgcatccgccggcttatcgccgaccgggccgtgtcccgggccgacgccctggaaaccggacagttggccagccagttgtatgacgcgtttctcgtgcgcgcggccgaactggcccgggaagggtcgccgaagcttcccgagacggccggtccgtgctgcctggccgtgctcggcagccagggccggcgcgaacagttcctggccacggaccaggacaacgccttgatcctcggtgatggcgtcgacgaagcggccctggccgcttttgccgctcgactggaacaccagctggccgaggctggaatgccgccctgtcccaagggcatcatggccgccaactcggcctggcgacggccgcttggggactggtttgcggccatggacgccgccgccgcccgcccggatgaggaggcggtgcttttcatctcgcttctggccgatctgcggccggtctggggcgaggcgtccctggccgccgccctggccgagcgggtgcgccgccgggccatggaatcgagtttgctcacccggggactggcccgggaggccctgcgtttcgggccgccgacgctgattttcggccatctccccagcggtcttttcggccttggccatggcagcctcgatctcaaggccgccgccgtgtatccgctggtccttggcgtcaaggccctggccctggaggccggcatcgccgcgccggacaccctggggcggcttgccggcctagtcgcagccggctgcatggagccggaactcgccgcggccttgcaggacggtctggcccgggtccagtccctgcgcctggctgctcaggccacggcctggagccggggacaaaccgccgacaaccgcctgatcccggcgcgcctgtccgccgagacgctggccgatctcgacgccgccctgcgcgccgccggccggttgtccgaaatcctcaagcaccactttagcctgcactgtctgacctgatcccggaggcccgccatgtccctgcccgatccctcgcgccaacccgatgccgtggccgccttcctggccgtcgtgccgccttttgaccgcctgccgccggacgaacggtccatcctggccgctgtcggccgggtggagttgttccttgaaggcgagaccatcgccgagcctgatggcgagacgaccgaggaggccgtgtgctgcatccagcgtggttcggtggtgtttgttggccagggcgacgcctcggggctggccgacgcgcgcggggaaggggagtgcttcggccttggcggcgcgcttcccggcgcatcggaaggctgccgggccgtggccgccagcgacgcgtttttggtgcgtttgcccggcgcggcctatgccgccatggccaggcggcatccctttgtggccgcctatttcgccaactgcctggacaagcaagcctgccgggccgacgacggtctggggttggaagcggccgaggccgatggggactacctcttcacccggctggccggggaggtggcttcgcccggcatcgtgtccgtggcccggggcacggacctgccggccacggcccgggtcatggaggaagccggtgtgggctcggtgctcgtgcgcgaggcttcgggcacggtcatcggcatcgtcaccgaccgcgacctgcgccgggccgtggcccggggcatgggccttgccgctccggtcgagacgctcatgtccacgcccgtggccgccatcgacgcggtaacaccctgtttcgaggccttaagccgcatgaccgaggccggcatccgccatctgctggtgaccagggacggggagccggccgggctggtcacggccaatgacctgctcctggcccacggccgttcgcccatggccctcttgcgggccatccgccgggcggccggcctggacgaccttatggccctgtcccatcgggccggccccctggccgccgccctggccgcgcgcggggccggagcggccacggtgggcggcatcctggccatgaccgcccagggcctgctcgggcggctggtggagctggccgagcggcgtttcggcccgccgccgggcaaatggtgctggctgctcctggggccggccgcccggcgcgaactcctgcccggccagggactggacgcggtcgtggccgtcgactgcggcggggacgacatcctggagcgggccatggacacctactgccgggccgtgctgccggccctggccgaggagctggccgcctgccgcctgggcggcggccggcttctgggtccggtgcggctgtcgggcctcgtggccctggctgcccagggccgcgatctggacggcctggacctgctgccggccgtgggcggggccggactcctggacgcggtccggcagcggctggccgcggaccggccggacccgggcttggtgttgtccgccctgggtgcggtggtggcccggccgacgccgcttggggtgcaccaggggaagctggccgagcgggccgggggctttgccccggtgttcgatctggacggacgcggcagcggggcggtttcggccatggcccggctggcggcggccttttacggactgccggaactcggcacggccaggcgtctggccgccctggccgccaggggccatctgcccgagacggtggcccaaaacgccggccaggcctgggcgtttttcgagggcgagcgcctggccgcccggctggccggccaggccgaccccgatgtcgtggcccggccggggatgctctccgccagaaaacgccaggaatgccgggccgcctttgccgccgtggaggctttgcgccaaacccttgccgccatgcttgccgggatgggggccgggcaatgagccggcttctgagcggtcttctggatcgcctgaggcgtccctttgtccggcccccggtccatccggccctggccgcccaccgggccgtccaggccgggcgcaaggccggggcgtttcttggcgacctcgaattcgtggtcctcgacaccgaactcaccgggtttgatcccaaacgtgacgccatcgtgtccgtggctgcggtacgtctgcggggcctttccatcatggccggcgagaccttcgccgctttgacccggccgcagcgtgacgtgccgcgccagtcctccctggtccatggcctgaccgcctcgaccctcagccaagccgccgatcttgaggccgttttgctaaggctcctcgatttcatcggtccggccgtcatcgtcggccatcatgttgatttggacatggggtttttaaacgccgccagccgccgttattttggcgacgaactggccgcgccctgcatcgacaccctgcgtctggccatggcctacgaagaaaaacgcctgtccctggagggcggggccgggctggaacatgccgccttcgacctgccaagcctgtgccgtcgctatggcctgcccgaattcgccgcccatgacgcccgacacgacgccctggccgccgcctacctctttgtctacctggccaaaaagctcggtcaaggccgggcgctgaccctgcccgacctgtggcgggccggccggcattggtggatgtagtttttggccggaaaccaaaaaaaggggttgacgaggcagggcggagtctctagataggaatcaacagcaactaggaataagacctatgcagatcgacgccctcaaaatactgttcgcccaaagcggcctcaagtttaccaaccaacggtatctggtatacaaggccatggtcgaagcccgggatcatccctcggccgagacggtctggcggcgagttcgggagtcggctccggccatttccctggatacggtctaccgcaccctggcttcgctggaggcgcgggggctggtgacccgggtgccgggaggggccgaagagagccgcttcgacggggacgcgtcgccccatcaccatctggtgtgcttgcagtgcgggggcatcgaggatttcgtcatgctcggagccgggctggccgatctgccgccggaagtggcggcctggggccgcgtgcgcgacgcccaggtgctggttcgcggcgtgtgccgccgttgccttggcttgtgaaaacaatcaacccaactcaatacaaggagcaagtgatgtccaagaccatgaacaatctgcaggaagcttttgccggcgagtcccaggccaaccgcaagtatctcgcctttgccgcccaggccgaaaaagacggcatgatcggcgtggccaagctgttcaaggccgccgccgccgccgagaccgtccacgcccacacccatctgcgcaacatgaagggcatcgggaccacggccgagaacctcaaggccgccatcgagggcgaaacccacgaatttaagtccatgtacccggccatgatcgaggaagccaaggccgagggcgataaggcggccgagcgcggcttcactttcgccaacgccgtggagcagctccacgccgagctctattccgccgccgccaaggaccccgctggctatcccgtcgaggattggtacgtctgctcggtgtgcggctacaccatcgccggcgcggctcccgagaagtgcccggtctgccaggctttggccaaggcgtttttcaaggtcgactagcgtcgcatcccttgaaaaatacaagcgtattttttaaggaaaatacatgggatcagtttgttgtccgcgaaatgtccgaagtgcttttcgtggacgcgacgcgagccgtaccgggacgcctggcgtccctgggcaaaggagcgagcatgtccgcgcctgagaacatgtggcagtgtcagaccaccaattgcgggtacatctacgatcccgaccggggcgaccgcaaaggcaagattccggccggaacgtcctttgaggatcttcccgaaggttggaaatgtcccatctgcggcggcggcaagaagtgcttccgtcccctggccggccctgggtcgaccaaggaagtcaaatgtcccgtctgacgactgggcggcccttgccgggccgcccgtcccggattcccaagccccgcaaggggcttttttcatgtccgatggtcgtggtggcccaggtgcggcgtctcgcggaggcggctggcggcggcagccagcagattgcagaccgcgccctggatgtccatgagttccacgggcatggtcagtatctcccgcggctccttggccggcagggccgcgaaccgggcggcctggtcgtggttggcggccagaaagagcgtggggcggtcccccttggcggccaacaggtcggcaagccctgccgacggcgcctggcgcaccaggagcagatccggcggctggatggcggcggtttcgtcggacatggggcaaagctcaaggcccaggtcctttagaatattttcgagaatggctcgccacatgggatcggggcaaatgaccatggccttttggtcgggctgggacaggctcgggttcgggggcggcgtttcggtcctggccggggcgttgtcctcggcaaggatctcgtcgccggtctcgccttgtgctgccccggccaggctgtcgaggagttcgcgcacgtcctcgatgcgggcttcggtgtcccgggccgcttcggggtcggtctgggccagcagccgggaattggccgccagccgccgcatgagggcttccaggcgtctggccaattcaccggagacggccggccggcccgaaccgctcaggcccggcggcaggatcggggcctgctggaggcggatgacggtttggtcgaagaaatgctccggccgggtgaggttcgcgctgtcgcggccggcggcgtccagccgcctggccaaatcgcggaaggccttggcggccggcgaggcgctttccatctccaccaggggcgtttgccgggtggcggctcggtacagggccggatcgtcggggatgatgccggccaaacggcaattgacgcccaggtggttttcggcggttttctggatgcgctcgaacacggcctggctgcgctggtgggacagcgaccggttgatgacgataagcggcggccggtgcaggccgttttccttgaaaaccttgatgagagcataggcgtcggtgatggaggacggctcgggattgacgatgaccagcacgtcgccgcaggccaggcacatggagacgacctgggccgaaatgccgggcgaattgtccaccagcagatagtcgtagttgatgagcttgtggaactcgcgcaccagatcggtacgcttgttgcgcgacagctcggccatgcgcgacacgcccgacgaccccgacaccacgtccacgtttcgtcccacggacaagatggcccgctccatgggcacgccgtcgaacagcacctgctccagggtgaccaccgggttgatgcccagcagcacgtcgacgttggacaaccccaggtcggcgtcgagcaggcagacccgcttgccgagcccgcccagggaaaaggccaggttcacggccacgctggtcttgcccacgccgcccttgccgctggccacggccaggacccgggtccaggccccgccggtttccaggaggccgtcctcccggggcaggtcggaggttttggattcggcgacgcggttcatggacggacctcgctgacggccctgccctcggggacgggggtggccaggggcaggcgcacggcaaaggtggagccttcgccgaggctggtgaacagttcgatgcgtccgccgtgggcgctggcgatacgctgggccacggccagtcccaggcccggcgcgccgttgcccgggatactctggtagggctggaagatccgggcgcgcacttcgggcggaatgccgccgccggaatcttccacggcgatgaccagatcgttttcgtggatgtccaccgaggcgccaaggctaagtctgccgccgtggggctgcatggcctccagggcgttgaccaggagatttttgaaaagcagccgcaactggcggggatcgccctgaatgttgggcaggttgtcctggaaggagcgttccacgacgatgccgttggcggccaaggtgtgctcaaaaaaggacagggcctgggccacgatgtcgcgcggacgaagggtctcgaaggcggagctgtcgccggtcgtggtttcctggatgttttccaggcgcatggtggcgatttcgagctgttccaggctgttggtcagaatttcttggccctcggcgtctggcaggcgcgcacgcaggaactgaatggccagccggacgttgctgagctggggcatgcagccgttgaagatgcccagggccgcctggttcatggcggcctggaagctcagggcgcagtcggccggcgcatcgggcagggcggcgccggcggcctccaggctgtcggggtcgcacagggccgagagcttggttttgatctcggcgaggtagagctttttgtattcctggagcagccacttgagttcggcgatgccctcggcattgcagggcagccaggcgggcttgggcgtggggctgaaactgtggttgaactgcagccccagttccatgcggccggaaacgaggtttgggcgctggtagcggatggaggccacgatgaggaattcgtggcgctggctgccggtgggaccggggaaggccatctggagcagcagatcgcgaccggttttgatgtcctttttatggaggcggtaggtttcgcggtccagggagacgcacgcccccttgggcgaaatgtcgatgagtccccgttcgtggtcgaagcctttgggcatgtgcaggatgagcgggttgaccatcttgagcaggcggatgttgtcgcacttcttgaccaggcaccaggcggccaggatgggcgcgtggcgcggttcgagctggagccggtcggtcttgttgtgggagatgcggtcgatgtgccggggcagggccaggcgcaggcgcgtggccgagacggcttcgatcaggctggtggtgcaattgatgaaccccggcggatggtcggcgtcgggcagcagatagatggtgatgtcgatggtctggcccggggacaggctggccgggtcaaagggatggtacaggctttcgatttccagggcttcgccgttcatggccacgggccggaaattgagccggtcggtgaggccatggggctgttgcagcttcacttgatagatggatcgcctggccagggactccttgatgacggccacgggagattccatgttgtcggtcgtgtgcaaaaagaacagaagtttgcggaggtattcgagtatcatggtgttccgatgccggttatgctgacactgttatgcatgaaacggaccatgctgtggaggcgtatcctgattttgacctgtttggaacgaaataaactatttcattgtttctgtattgaatagacagtctgatatgtgagatgatattttgcgaactccattgttgatgatacgacactggcaaagatttgtatgatttgtcaagcgtattgctcgatgatgatggccggaatatggaatgactgcagccgttgccgtagtcgttggcggtcgtttcgcatgcacgatgccgtcgtgcccaggtcgaaggccggggcacgagaggcgttatgcagcgacatcggatcatgatcgaaccatgctccaacgggcagaacttgggctgggcgtcggcgttttggccggcgaaaggcagggcggtcaggcggccctgggggggtcagtcttccggcaggcagtcggtcggggccggggccgcgccgcgctcttcgagcacgtggcggtagtcctcggcgtagagcgtcagcatcaccatggcaaagcccaggatgagcgggccgtagaggatgcccagggccccgaagaacttgatgccgccgatgatggagagaaacacccagaaggtggacatgttggaccggttttgcatgagcagcggccggatgatggaatcgatgcccgagaccacgacggccccccagcccatgaggaaaagcccccactgccaatgcccggtgagcatgaggtagatggccacgggcagccagatgatggccgtgccgaccaccggaataagcgaggcgaaccccatcatgcagccccagaaaaagggcttgatgccgacgatgaaaagcccgatgccgccggccagcccctgggccagggcgatgaaaaaggcccccaggatcaccgacttggccacgtcgtcgagttggcggaagatgcggttttcctggtccgtggtcaggggcagcaggtagcgcagacgttgcatcatgcgttcgccgtcgcggatgaggaaaaacagcacgaacatgaggatcacgaagttcatggtcagcacgaacacgttgccgatgatcttggtgccgctgtcgatgagcatctggccggcggtcttggaaatgtcgatgagatcggcttgcagggcgagctttttgaggtcgagaaagggcagatgctcctggacccagtccatgtagggcgaaatggcttcgtggctgaaaagcttgttgaagtccgtggccgccagttgggcctgcagggcgttgacggattgcacgccctgggccaagagcgaccccaggaagaaaaagatcgggatgatgatgcaggtgaagataagcccggtggtcagcagagcggccagggtgggccgggggccgcaaagccgctcgacccggcgctgcacgggccgaaacagggcggccagcaccacgccgatgatcaaaatattgacgaaaggcgcgagcacgatggcggccaggctgagcgcgccggccaggataagcagcagaaacaccgaatagatgggcttgcgggcttggttcatgcaccggccttaccagaccggcgcgcccggcggcaaggccctggcccgctccacgttgtcaaatgcgatgcggcagcgccagcacggggcgcgcgcccagccttgttccccccgttgcgaacggcccctcatccggcatagagtttcgtccacatgttgcaaccacgccgagccgttggccttgattgtccccgggagtccgccccgtgaccgacgccccccgtcccgccgcgccgcgccgcgccctgccgccgccgacgcgggcctcgctgtggcccaggcccgggctgcgcgatatcacccagacggccaccggttcggcctcgccggccacggccatccgcgcccgggaatgggaactcgtgctgaccgcccgggccatcccccacgccatccgccgccagggcggcggctaccgcctgctcgtgccgcgccgccgggccgaggaggccctgaacgaactggccgcctacgccgccgagcgggaagcccggcccttgccggatcccgaggccgacgcggcggccttggccggccgcccgcccacctggccgacggttgtggccgtcatgggcgtcctggccggcgtctgggggatatttctgggccgcagcgtcatttttggccgcctcatcgactggcgggaactggccgccggcgattcggctcggatgctggccggccagtggcatcgcgccgtcaccagccttttcctccatgccgatccggcccacctgttcggcaacgcagccagtggggcgcttttcctgtcgctgctgtcccgggaggtcggggtggggctggcctttttcctgtccatcgccgccggcggttgcggcaacacgctcaaggccgtgatccagggtccgggcatgcattttctcggcgcgtccacggccgtgttcggcgctcttggcgcccttggcggagcgcggctggcccaccgctggccgcccttgacttttcgccgctcggccccggccggggcggtgctcatgctgctggccatgctcggagccggcggcgaggacgccggtcccatcgatctggccggccatttcttcggctttctgtgcggcgcggtccttggcctgtgcgccggtttcgccgtggcccgccagggccggcccggccgcgccgcccaggccgccttcgccgccgccgctctgggcgtggcggcttgggcttttggcgcggcgttgaggtaaggaaaaggctggaagagaaggaagatgcctccggcggctgggggcctgaggcccccagacctcccaaatggggataggggggcgaaacggggtggggcggccaggaaggctttgccttgggcggcgttttcggataagcccatggatcgtcgccggtcgcgccggttgaagcggcggcaagacgcctgcaagtggggatgccatgagccttaagggccttgtgttcgagggtgaggagatccggtaccggacgggcaagcactggatcgtgctggccaaggcggcggtgctgtttgccttggccctgatcgtctggtcgagcgaaccgacgctcaccaagcttgtgcagttcaaggtgcccgaggaactggaacgcttcgtgccgaagatcctggctgtcggcgtgtggcttattcgctatgtgttcttcatactgttcacgctgctggccttggtgcggcttttctcctttttcaccctgcgcgtgggcctcaccgacaagcgtctgttgtgcgatgacgcgcttttcggcagcttctcgctggatctcggtaagatcgagtcggtcaagtgcgagcctggcgttttcggcggcctgctcggctacggcaagatgatcctgaccgcctcgagcagccagcggctggttatcaccaacctgcgccggccccatgtgctggctcaggagattttcgccgcgaaatagccctccggggccggcccgggccgcccgacccgtggccgcctttccgggccgtggaccgccgccatgtacctttcccgcaagcccatcaaacactacggcatcttgttcaagctgctggtggttttcatcggcatcatggtggtggcctatttcaccatctccacgctgctcatctatatcaaggattccgtcaacatctcccgtgatatcgtcaaggtccgcatcgaggtgctcaccatctcccagcgcctggtggacagcctgcttgtcatggaggagaaccagaagaaatacgagatcatccactccgaggaatacaagaagaacttcatggcggcgctcagtgaatataaaaacgccatttggagcatcttgtggttccgctacgagggtttttccgcctgggaagagctgcacgccgagtttcgcaaggcctttcccgatctggcccagggccgggagctgaccaaggaaccctggatcgaccaggatacgctcaaccaatggatgcgcatcgtggtcagcgcccgccaggacaacgaacgggtgctggaatccggcatgcgcgaactgtttcgcatcagcgaagcggccgtgtcgcgcggcctgtccgggctgaccatttccatcggcgtggggcttttgggcgtgctctatctgacctattccttgagccgtcccctgcgcgaactgcgccggggcatccgggcctacaccagagacggccggctggaacccatccgggtgctttccaaggatgagctcggcgaactgggcgcggcctttaacgacatgaccgtgcgcctcaaggaagaggaacggatgcgggcggatttcatcgacatggtcagccacgagatccgtacgcccctgacctcgatccgcgagtccgtcaacctcatgcgcgagcgggtgctgggcgacgtcaacgagcgccagaagcgctttctcgacatcgccagcgacgaactccagcgcatttccgccatgctcaccagcctgctcaaggtgtccagcatggcctcccagatcgtggacctcgcgcccgtgacctttaatcccgaggaactcctgcgcgagaccctggaaaaggccggtccgggagccgaggccaaggacatcgccctgacgccgcgcgtggccaaggacatcgtgtccgttgtcggcgaccgggagctgcttggccaggcgctgtacaatctggtcggcaacgctgtgaagttctccccggccgggcgcaccgtgcgggtggggctggagctggccgacggcgggcaaaaggtgctggcgagcatttccgacgaaggcccgggcatcccggaagaggagcaggcctacgtcttcaacaagtactaccgcggcgcgcgcaccaagcgcagcaccgacggcatcggccttggcctgagcatcgccaagaccatcgtcgaagcccatggcgggaacatctggctgtcgagcctgcccggcaagggatgcactttctactttacaattcctgtggatggggcaagagcgtagtatgggccactgtgtttcacgtcgtatcggatcggccgccgtctgcggcctgtgcctgcttttcgcgcttggcggcctgggttgcgcccgccgcgaaccggttcccgtcgcgccggcagccgcccccgcgccgccgccgcccgcgccggcccgggaagtcgtcatttgcaagatcgaacgggagacagcctacgatcgggggctgaaggcctacgaggctggcgaggccaagcgggccatggccctgtggcgcgaggccgccggcgacgccgaactggccgtgcgccagaaagcgcttttcgccatggcttcggtgaagctctcccaggccggcagcgacgccgaactcgccgccgccatggaaatgttcgacgcctggtccaagaaatccccgcccggcggcagcggcgaggatgcccggttcctcgtgcccctgctcaagtcctacaagccgggcttcgcgcttaaggagcaaaaggcgtccatggaccgcgactgcgccaaaaagctcgccgaacgcgaggaacaggtgcgaaggagcctccagcagcaggtcaaggccctggagaccatccaccagcagatccaggaaaagaaaaagggcctgacaaactattaagaccggcgcgccacgccgccaaggccgcccagaagcacatgagcataggcccccagcagacccgaaagaccatcctggtcgtggacgacgatccgcacatcctcgaagtccttgaggtgcggctcgtttccgccggctatgacgtggtccccgccgccaacggcctggaggccctggaggtgctgtcgcgccagcccgtgcgcctggtcatctccgacatgcgcatgcccggcatggacgggatgcgtatgctcgaagagatggagcgccggggcatcaagctccccatcatattcttgaccgctcacggctccattcccggcgcggtggaagccatcaagcacggcgccgtggactacctgaccaaacccttcgacggccaggagcttttggcccgggtcaccgacgtcttcgccaaggcggccgggcttgacgcggccaagaccatcaaggccggcgacggcggccagctcggcgaaaccggactagtcggccaaagccaggccatgcgcgacctggccgcgctcattgaacgcgtggccccccgcgacgtcaacgtgctggtccttggcgaatcgggcaccggcaaggaactggtcgccaatctcatccatcgccgcagcgcccgcaaaaacggccccatcgtcaccgtggactgcggctccaccccggccggcctgctcgaatccgaactcttcggccacgtcaaggggtcgtttacccacgccgtcaaggacaaaaagggcctcatcgagcaagccaaccagggcacgctctttcttgacgagatcggcaacatctccaccgaaatgcaggtgcgcctgctgcggtttctcgaaaatcacaagatccgccgcatcggcgacgtgcgcgaaatccaggtcgattgccgggtcatcgccgccaccaacgccgacatcttcgagcaggtggccgagggcgtcttccgcgaggatctgctctatcgcctcaaggtcgtgaccataaacgtgccgccgctgcgcgaacgccgcgaggacatccccatcctggccgagcatttcgcccgccagttctgcgccgcccagggcatgccgccggtgaccatccccaccgagaccatggcctacctcaccgcctatccctggccgggcaacgtccggcaactgcgaaacgccctggaagccggggtggtgctcggttccgacggcgtgctggccccccaggacctccagcttcccctggccggcaagggccccgaccgttcgcccgacaacctgtccctggaccagagcgaaaaagccgccatcatgcgcgccctggaacaagccggctgggtccagaaggaagccgcgccgctgctcggcgtcagccgccgcgcgctcaattacaagatccagaagtacggcatcgagataccaaaacgccgggtgaagaagtaagaaagacgggaagatgcctctggcggccgggggccgaccgcccccccggaccccccgaaataatgggaaaaggggcaagtggggaggggaagggctggtcggtgagctgcctcgacttccccgagttcgacgtttgcccgccacgcctgccacgctgtcccgacgctcgcccgcgtacccgaaaaatcacgcttttgtcgtcgtctgttcttgccgccgccttggcaaggggtgcggtttctgtcacaacgacgaaacgatccccaatggatcgaccggccgcgttatgcggccggcgtgtcgcgggatcacggactataagccggccctggccggaatcgggtggcgcatgttgcaggcggaaggcgcgtcttcaaaccagaccggcaagtcggccaggatcgccaggcaagtggtcctgccctttggcaagtcgctggaaatcagtatcaaaagcatcaaggtccggtttttccggtccatgatcaccgtggccagcctggttttggccgtggccttcctgagtttcatcctgaccggggccaacgtggccgccggtcttttgcgctccggcgaaccccgactacgcctggccctggtcgaggccggctacgacctgccgagcctgccgccgccgggcgtcgtggcccaggacgaagcgggcaagctctccgccagtcccaaggaacgctggatcgtcatcctgtcgcttctggtctgtaccgtaggcatcgtcaacgcccaactcatggccgtcaccgagcgtttccgcgagatcggcaccatgaagtgcctgggcgcgctggaccgtttcattttgcggctgtttttgctcgaagccgggatgcagggccttgtcggcgcgtttatcggggccatcctgggcgttgtggtcgggctgctggtcggactcgtgcggttcggactggccgccgccgccaatctgtcgcccctggacgtgctggcgaccctggggatttccgtggccgttggcgcgggcttgagccttcttggcgtggtctatccggcggccgtggccgcccggatgcgccccatcgaggccatgcgcgcccaggaatgatgtcgccgcgcggccgaacctgccgcgcggacgtttgaagcagcgggggagtatggccgaagcgcacaacatcgtccgagtggccggcgtcgctcgaaccttcaccatgggcacccaggtggtccaggcccttcgcggcgtggacctcaccataaaagccggcgagtatctctccatcatggggccgtccggatcgggcaagtccacgctgttcaacatgatcggcggcctggacaaaccctcctccggcaaggtcttcatcgacgaggtggacatcgcccagctcgacgcctacgaactggcctggctgcgcaaccgcaagatcggctacattttccagacgttcaaccttatccaggtcatgaccgccctggaaaacgtcaccctgcccatgacctttgccggggcttcccaggacgaggccacggaaaagggcctggagcttttaggtctggtcggtctgcgcgaacgccacgcccaccggccccaggaactctccggcggccagcagcagcgcgtggccatcgcccgctccctggccaacaccccggccatcatcctggccgacgaacccaccggcaacctcgacctcaccaccggcgaggagatcatcacgctgctcaagcgcctgagctccgaacgcggcgtcacggtcatctccgccacccacgattacaaaatgctcaacgtctccgaccgcgtggtctggattcgcgacggtcgcattgacaagatcgaggagcgctccgaactcgacatcaccgtgggcggcattggcgcccgggaggcctagtcctccatggcgactccccgtttattgtcgggcgcttcggttcgtccctgggcctggctgtggctgctggcggctttgtgcctgcttgccgccggtccggccgaggccaagcgggccaagaaggccgtcccggacgccaaaggcgcggccatggccgaagcctggctggccgccgacgcggccgacctggaccgggtcgtcatcgagtccctggccggccttggcgaccggtccatcggcacgccaggcgggcggctggccgccgacgccgtggaagcctttttcaaggggctggaggccggcgaggtggggcggctgtcctaccgcgctccggccatgctccatggcccggccagtcttgccgtggacggcgggggacgggccgatgtctcacccctggccctaaatgccttcacccccggctcactgccgccggagggcctcatcgggcctgtcgtctacgctggggccggcggctaccgcgattttgacggcacggtccccaaggacgccatcgtgctcatggatctcgacagcggccgcaactggcaggccgccgcccagctcggggccagggcgctggtctacatcgacgacagcccgccaaacgatccggccggggccggcgtctaccgcgacaagttcgaactgaccccggtgcgcttcccgcgttttctgctctcggccgccaaggcccgggagcttttcggcgattataaatccttgaaggggacccccggcggcgcggccgccaccttggccgccaaggccggctgggagccggtggtggctgacaacgtccatgtgttcttccccgggaccgatccggccctggccggccaactgctggtcatcgacgccgcctacgacgccgccgcctatgccccgggccgcgctccaggggctgacgaggctgcctccctggccgcgctgctgcgtctggcccgggagttcgccgctcagcctccggcccggccgacgctgctggttgccacctccggccgggggcagtccatggccgggctgcgagaatttttcgccgccctgcgcggcaagggcaaggacctgcgcacccaggctcgcgacctcaaggaagccgcccgcaaggccgagggcgtggtcaaggccctggacgaggccgctgccggcggcgaagcggccaaggccgccctggccgatcccggcgtgcgcgaggcgctgctggaaacgcttaaagacgaagtcgatgtcgtcaccacccggctcatgcgcctgcgtctggccggccagacccgcgacgagaccgccatcgccgccctggccgaacgccgggccggcctgcggcgcatcatgtggcgcgaggatttgaccattttgcccccggccgaggccgaaatgctcctggctctggccccggccgcccgggaacggctggcccgcgaccgggccggagccgaggccgaggccggctgcatcgaaagcgcccgggagctgcgaaagctcatcggcgaccgcgacgtcacggcccaggcctcgctctatctttccagccacggcgaaggcgtggccagcctgtgcgaaggtttcggcttcgaggtcaagcccgacgtcaacccggcccaggcttacggccgcctcaaccggtcgctgtccgccgccgccgaggccgcggccaaggcggtcggactcccggccggctattaccgcgacgggatgcgcgacgaccgccagaacccctggcagggcctgctccctgaccggcccatccttggcggcgaattcggcaatatggccggcgtgctgggattcaccctggccaccgttggcgacgccagactcgcctggggcacccctggcgacctgccggcgcgcgtggatttcgcggcccttgaaaagcagggccgctttgtcgcggccatggtcgcggccatggcctctcccggcttcgaggccggcgagaaacggccgcgaaacgtcttttcgaccctcaccggccgggtcaacttcatccgccagggcgagcttttccccgaccgcccggcccccggcacggtggtgtgcgtctaccagggcaagacccggttctacgccatgaccgacgctcgggggcagtttcgggtaaacggtctggccaacaagaagcatgttctcgacaaggccgtggtcgaaggctaccgctttgaccccgacaccggctcggccatctgggccgtggacaagaagcagaccggcaaggacgcctaccgcgtcaagatgaatcgcaacgccatggaaaccgacctcatcatgttcggttgcgagcagaccacgctgttttccgccttcgatccccggtcattccgctatttcacccgcatcgagcttctcgacgcccggcgcgaggccccgcccttgcgctcctggttctcgcgcctggacaccctcgattccacgctgctttccatcttcctcgaacccggcacgccctttaagtgcatcctctccgacaccgtgctggcccgaaagcttctgctgttaaacgccgacgccgcccaccccaccggcgtgggctatcccgtggacgcctggcccatcctgccggccacggagcttctgggcgcgcgcgacatgtgggccctggtcggcccgcgcatcgccaacctcgaagcccacggcatcgtcagcgaccgcatccgcgatctcaccgaccaggggcgcgccctgtacgcccaggccctggccgccgaggaggccggccgtttcgacgccatggtcacggccgccaggtccagctgggccttggccgttcgggtctataacgatgtggaaaagacccagcgcgacgtgctcattggcgtactgttctacatttcgctgtttatcccctttgcctactgcgtggagcgggtggtcttcaactacgccgacatccacaagcgcatcgtggccttcctgggcaccctggcggcggtcatcgccgtggtctacgccgtgcatccggccttcaagctcacctacagtccactggtcgtcatcatcgcctttttcattctcggcctgtcggtcatggtggcggccattatcttcctgcgcttcgaacgcgaaatgacggcgctgcagcgccgggcttcccacgtcaaggctaccgagatcggcgggatgcgcgcctttgccgccgcctttgtcattggcgtgagcaacctgcgccgccgcaagatccgcacggcgctgacctgcctgacgcttgtcatcctcaccttcaccatcatgagcttcaccagcgtcaagtccacccgggacgagggcgcggccaaactctcggatgccgccgcctaccggggcgtgctgctcaaaaacatcggctggcacagcctgccgcccgagtctctggccgtcctgcgcgacgcgtatggcgcaagcgatgtggtggctcccctggcctggctggagctgcccgaaaagaccgtggccccggttacccgcatccgggccggcgagcgcggcgaggccgtccagggcgtcatgggcctgtccgccgacgaagcccgccttggccgcgtggccgacatgttgaccgacggccgctggttcgccccgggcgacgacgacgccgtgatcctgccaaggcccatggctgagcgcctgggcgtggccccgggtgatcaggtgtcgctttttggtcgggaattccgcgtggccggactgttccgcaaaaacgccctggaagagcggcccgacctggacggcgaaccgctcaccccggtcgtcttcccgtccgaagcctccaaggaggccagcgaggccgagaaagaggcggccgagtccggcgaggacgtcaaaaccctgcaaagccgctatcagcacatcgacgacgatctggtcgtcatcctgccctacgggacgctcatgggccttggcggccagctcaagtccgtggtggtggccccgccggctgatgcttcgggcgtcgcgacgacggcggcccaggacaacgccgcccgggctgggcggctggccgaccgcttcggtctggccgttttttccggtcaggacgacggcgtgttcctctaccatgccggcgattccctgggttatgccggcgtgcccaacatcctcattcccttgatcatctccgtgctcatcgtgcttaataccatgatcggcgcggtctatgagcgcaaacgcgagatcggcgtctacaccgccgtgggcctggccccgtcccatgtctcgtttctgttcatcgccgaggcactggcctttgccgtcatcagcgtggttctgggctacctgttggcccagaccacggcaggcctcttgtccggcacctcgctatgggccggcatgaccgccaactactcgtccacggccggcgtggccgccatgctgctggtcatcgccgtggtgctcctgtcggtcatctatccttcccgggtggccggccagatcgccatccccgacgtcaaccgctcctggacgctgcccgaaccggtaaacggcgtcattgccgcgcgcctgccctttctggtcaaggtgcgggagcaggagtgcgccggcggcttcctgctggactactaccaatcgcaccaggacgtctcccatggccttttcgccacggccgacgtggactacgccttcgaatgcccctgggacctgcccggggcggcggcacaccccaaggtggcccatcccgaattctgcgatttgcgggcctgtatgcgcctgaccggcacggtctggctcgcgccgttcgatttcggcatcaagcagaccatgtcccttatctttacgccggccaaggacaccccgggttatatggaaatcgacgtggaactgacgcgcgtcgccggcgaggccggcatgtggaagcggctctccaaaggctttttgaacgacctgcgcaagcagctcctggtctggcgctccctggaagagtccatgcggacctcctatgaggacaaggtcatcgccggctacggcgcgcgcctgcgcggcgacgccccggccggggagggcagggcatgatcgccgccggagccattcggacccggggcgtggtcctggggctgtgcctggggcttgtggtctgcgcggtcacgccgcttaataacctctacctcggggccacgcccctgggcggcggccattttcccttggccccgtttttcctgctggcctggctcaccctcctggccgccggcctgggcaagctctttcgcggtcgctcgcccctttccggcacggacctgctcatctgctggatgctcatggtggtggtttcgggcgtggcccacaccggcctggcccgcacgttctttataaacctcaccgcgcccctgcatttcgccaccgagggcaaccagtggcaggcggtgtttgggccgatcctgcccaagggctggtatccggccgatccggaagccgtggagaccctctataacggcctgcccggcggctacaccatgggttggggggccgtgctggcggccgttccctggcaggcctggctcgggccgttgaccacctgggccgtcttcatcggcctgtgctatttcgtgctcctgtgcctgaccaaccttttcgccaagcagtgggtctccaacgagcgcatgaatttcccgctgctgcgcctgcccgagaccctggccgagtccgtggacggcggcggcctgggcgcgcttttggccgaccggttcctgctgtgcggcctttttatcagcgtcggcttgcacaccataaacggcatcgccttctacgatccgtccgtgccgcagattcccacgctcatcctggccgggccgtactttcccaaaacaggcctcttttcgggcttcaccaagctcaagatctacttctatccggccttcatcggcttcgccttcctgaccgcccgccagatatcgctcagcttctggctctttttcctgctcggcggactggtctacggcgtgtttgatctcatcggccagcacattccggccgccgccctgggcgtcaccttcgggccgaccctgacctcgcccgaggaaacgcagatgatcggggcctacggcgtctttttctgttttctcctgtggctggcccgccaccatctgctggataccgcccgggacgccttacgcttccggtttcgcggcccggacgaggccgaatgggtgggcgcgccggcctcgttgtgggggctggtcctgggcggcggggcgcttattgcctggagcgcctcgtttgggatgccgcttttccaggccaccctgctcatgggcgcgtttttcatggtcatgctggtggccagccgcatcatctgccagggcggcatcgcctatttcaccctgaccgccgcgccgaccgacggcctcatcgcctttttcggggccggcatcttcagccggctgtcgctgctcatggccgccgtcatgcagaagatgctctttgtcgatctgcgcgagtcgcttttgccgtcgctgttccacgccgccaaggtcggcgagcggcgggggccgaaaaagctctacctggccgccattgtcctgggcatcgccgccgccgtggccgtatcgtttttggccatgctggccgtgtgccacaagtacggcctgcgcgacctgcaagtggactgggagacccagaccgtgagcacggtctatgaaaacgtccagcgcctcatcgaagcgccgacaggttccaacgcggcggtcatcggcttcgccgccgccggcgcggccgtgatgctggggctggtcatcgcctaccagcacttctactggtggcccatccatccgctgggctttctcaccatgtacagctcggccatgcggatcctgtggttttcctttttcgtcggctggctgtgcaatcagctgaccttgcgctacggcggcatcgcgctgttaaagcgcgtgcggctgctgtttatcggccttattctcggcgattttctcatgggcggcatcttcgccgtcatcggcttgtggacgggacaaagctatctggtgctgccgaattgatcggaaggcaccggatgttgcggtagaggtcctgacgctgttggatggcttgcctaggccagccaaacgccgccaggaagacataaggacaggacaccaggaagcccgatgtacgacgacaaggaattagccgaataccgggacctgctcccgacccccacccgcttcgaagagggcttcgactggaagaccattgtcggcgcggtcttcatcggcttcctcatgatgccgggcagcatgtatttgcagctcgtcatcggctcgggcatcggcccggccgcccgctgggtgaccatcattctctttgccgagatcgccaagcgcgcctacaccgaactcaagcagcaggaaatcttcctgctctattacatggccggcgcggccatggcctcgcccttccacgggcttttgtggaaccagtacctcgtccagtccgacgcggccaagatgttgggcctaaccgaccttattccgctgtgggtcgccccggggccggactcggattcgcttttggcccgcacgtttctgcaccgcgactggctggtgcccatcctgcttttggtcggctcgcaaatcgtccagcgcatcgaccacttcggcctgggctacgccctttaccgcgtcacctccgacgtggaaaagctgccttttcccatggccccggtgggggccctgggcaccatggccctggccgagtccaccgaggacagaaagaccggctggaaatggcgcgttttttccatcggcggcatgatcggcctggccttcggggccatctacgtgctcttcccggtggtctcggggctggtcttcaccgaacccgtgcggcttattcccattccctgggccgatttcacccgcaacaccgaggcctggctgccggccgtggccaccggcatccagttcgacctggggctggtcttcaccggcatggtgctgccgttttgggcggtcatcggcgggctggtggggcttgtcatcaccatcgtggccaaccccatcctctattcccacggcatcctgcaccgctggcggcagggcatgggcacggtggacacggtttttgccaacaacttcgatttctacatgtcctttggcatcggcctggggctggccatcggcgtcatcggcatctggcaggtggccaagtccctgcgccagggaggcgttggcggcgcggcctacaaggcgctttttaccaccaacaaggcccggggcgacatcaacttctgggtttccatcgccatctacgtcttctccaccctggcctacatcgggttgtgcctgtggctggtgccccagttcccgtggctgttcttcgttctttacggcttcatctacacgccgcttatttcctacatcaccgcccgcatggaaggcatcgccggccagttcgtgagcctgcccctggtgcgcgaggccagcttcatcgccggggcgcgctttttcggctaccagggcatcgagatctggtacgcgcccatccccatccacaactacggcaaggcgacggtggattttcgcgagatcgaactgaccggcaccagccttcgcggcatcatcaaggccgagatcgtggtctttccggtggtcatggtggccagcctgctgttttcccagttcatctggcagctggcccccatcccttcggccagctacccctatgcccaggagctgtggcatctccaggcgctcaacacgctgctcatgcagacctcgaccctggaaggcaattcgctctttttccaggctctaaacggctggtacgtcagcgccggcctggggctggggcttgtcgtctacatgctgctcatgattttcggactgcccgtgcttctggtctacggcatcgtgcggggactcgggcaaagcgtgccccacgggcttattttggaagtggtgggggcgctggtggggcggtattatttcctcaagctctacggcgcgcgctggcggcaatacgcccccgtgctcctggccggcttttcctgcggcatggggctcatgggcatgttcgccatgggcgcgacgctgatcctcaagtcgctggggaaactggcctactaggccgacaggattccgttctgcgtcgccggaacggtgagtcggctggccagccgcgacttattccaatggtctttcaaaagcgaaagcacatggcaaatgacgtagtgatatgattgtttatgtataaaacataactgccgttatgttttatagcaggcattatccggcgcgctgcatgtccgcgatgagcttcctgagcacctgggtctggcgattgaggtcgccgaccgccgccgccgaacgttccatgatggccgacgtctccccggcgatgcggctgatgtcgcccaggctgcggttgatctcttcgctggtggccgactgctcttcggcggcggcggcgatggaactgacctgttcggtggcccggtcaacgaaactgaccacggcctcaagcacctggccggaagcgccggccttgctggtggcggcctcgatggcgctgccggccgcgtccacgttgcggatgttctggcgggttccgtcctggatggcccgaatggcctgcccgacctcggccgtggcggacatggttttttcggccagcttgcggacttcgtcggccaccacggcgaacccccggccggcgtcgccggcacgggcggcttcgatggcggcgttaagcgccaggagattggtctggtcggcgatgtcggcgatgacgtcgaggatggctccgatgccgtcgctgagccggcccaggccgtccacgtcgtttttgagggccagggcttgcgcccgcaccgcctcgatgccggatacgacctcggccacgacggccgcgccttccttggccttgccccgggccagatcggcgctggttgaggcctggccggcgtttttggccacctccaggaccgtggcgttcatttcttccatggccgtggcggtctcatcaatgcgttcggcctgggccgcagccccctgatgggcctgggacgactgctcggacagggtttcgctggccgaggccacaacggccgctacgtcttcgagctggcgggccgtggccagcaaggcctcgcggcttgcctcggcccgcttggcttcggcggcggcttgttccatggcttggcgggccttggctgcttcttcggccgcttcccggctcttggcctcggagaaagccattttttccttgaggctggccaccatggcgcgcatggccccggcgagcatcccgatttcatcccgaccggccacatccagccgggcgtcgagccgaccctgaccgatgtcttcggcgtaggccacgctgcgtccaaggggaacggtgatggaacggatgatggccagggagaaaagccccgtgaccaccacggccccggtcaagcccaggatggcgagcaaaagggtgcggtcgtagagttcccgggcgcttgcttcggcggtctggtttttttttgcggccaaggcggtgatatcctcgacgatgtcgtcaatggccttggtcggttcgcggtcgatgccttgcaccttctggtccacaagggcgctgaagcggggatcggacgacgacacggcctttacggcttcttcatactgccgcgtgagggcgacatgggcggtgacggcgctgtcgatggcctgggtcggaaaacgcagcttggtcatcgttgccttgagctgcgtcagcaggcgaaccacctcggcgtgttccttttgaaacaggttgacatagctttgatatttttccggattctggccacgcagcaagaggtttttccattcctggacctgttttttgaaagccacctgggccgagcgggcttcgtccaccgaagccgttaccagggtgctggtcgcgatattatccagagacatggcattgatctgggtcatgacgacaaagccgaaaatgccggagccgaccagtatcagcagtgccgtcccggtgagcaggaacagccgggtgctgattttcaggttgttcagggccatgtgttgctcctttttccggcgttttcgccaaaatcggtggagggtcgggctgggagaataacgacaattttgtaacagcattagaaaagaaggcaagagaccgggacaaaaaacgtcacaccgtgtagaaaaatgctgtccagagcggctaggggaggtgagaataggcttgacgggtggagctggtctggatataaaaacaaattttgcatcggccgaataatttggccgcatggtttgtctcacgacaaacccttgactcgtccccaaaacgacttaccagggttgcacgcttccctggccgcccggcgacgcgcgaacatcgcgcaaggagaactgcatggcgcgcattaccgtcgaagattgcctggaaaagatcaacaaccgtttcctcatcgtccagatggccatcaagcgggtgcaccagtaccgcgaaggctacgatccgctggtggagtgcaagaacaaggaagtcgtcaccgccctgcgcgaaatcgccgccggcgaggtgatgccggccgattccatcgaggaagccggcgtgtttcttcctgcaaccaaatagaaaaaacaatgccccgggattattacgaagtgctgggcgttgcccgcgacgccgacgacgagaccatcaagaaagcctaccgtcagcaggctttccagttccaccccgaccgcaaccctgacgatcctgaagccgaatccaagttcaaggaagcggccgaggcctacgaggtgttgcgcaaccctgaaaaccgggcgcgctacgaccgcttcggccacgagggcctgggcggcaacgggttcggcggtttcggcaccaccgacgacgtcttcagcgccttttccgatattttcggggagttctttgggttcagcggccgcgcctcgcgcgggccgcgcccccaggccggcaacgacctgcgctatgacttaaacgtctccttccgcgacgcggccaggggtacggaagtcacgctcaagattcccaaaaacgtccagtgccacgtctgcaacggctccggggccgaacccggcacctcggccgaaacctgccggcactgcggcggctcgggccaggtggtccagagccagggctttttccgcatcgccgtcagttgtccgtcctgccggggcgaagggcgcgtcatcgccacgccctgcaaggagtgccggggacggggcatcacccgccagacccgcgagctcaaggtccgcgtgccggccggcgttgacgacggcagccgcctgcgccttcgcggcgagggcgatcccggcctgtacggcggccccccgggcgatctctacgtcatcctccatgtcgaggccgacaagattttcgagcgccagggccaggatctcatctaccgccaggacatcacctttgtgcaggccgcgctcggccacaagatcgaggtgccgaccctggacggcgacgagaccatggagatccccaagggcacccaaagcggcgaggtgttttccctgcgcggccttggcctgcccattccgggatcgacccgcaagggcgatctgctcgtccacgtgaccgtggtcacgccccgtgggctgaccaagaagcaggaagagcttttgcgcgaattcgaggagcttgacgagcaaaagcccatgaaaaaagtcaaaagcttctttcgcaaggccaaggaggccatggggaactgacatgggcaaacgcatgcgttgcgccgtcatggcgctggctttgatcctggctctgcccggcgcggccgtggccggacccactgacgactaccgccagggcattacggcggccaacaagggcgacatggacacggccatcgccgcctttacccgcatcattgattccggggccggcggggacgtgaaaaacctggccagcgccttcaacctgcgcggcatgtgccaggaagccaaaagcgatctgcaaaaggccctggccgactactccaaggccattgagctcgacgccaagatggccgaggccctgggcaaccgggccatgctgtatatgaagctcggcgacgaggccaaggccaaggaagacgccacggccgccaagcgcattgaccgcaaggtcaaagtcccggaattcaagtaggccggctatgagcgaaggcttcacacatctcgacgccgacggcgcggcccgcatggtggacgtcggcggcaagaccaagacccgccggctggccgtggctgcctgcgaagtgcatctgtcgccggccaccatggcgcttttggccacggccgccctgcccaagggcgacgccctcaacaccgccaagatcgccggcatcatggccgccaagcgcactgccgacctcatcccgctatgccatccgctgcccctggcccatgccgacgtccggttcgacgtggatcaggccgccgccgtggtgcgtgtggaggccgaagcttccaccgtggccgaaaccggcgtggagatggaggcgctgaccgccgccatggttgcggcgctgaccatctacgacatgtgcaaggccgtgcagaaagacatcgtcgtgagccaagccaagctgcttttcaagtccggcggcaagtccggaaccttcgtctcgcccgactggccggccggccggccttatccggcgtcctagtcattggcgccaaccgatttatcgcccgcaggtgaaaacgcctgcgggctttttttatatcccggccggctggctcattgtccagcctccaccgactggctttgccttgcccgccaaagttgcgcccgggctgccctgtactggagcataaaaaaggccgcgacggatgtcgcggccttgagagcgaggtagcccgtcgagaggctatttacgcttgaggcgctcggccaggtattcggccacgtggcgcacttcgaaaggcgttttttcggcctcgaagccgccgcgaatctgcatgatgcagcccgggcaatccgtggccatggcggtcgcgccggtggccttcaaattggcgagcttcttgccgagcagttcctttgagagttccgggaacttcaccgagaaggtgccgccaaagccgcagcacacgtcttcctcggtggccggcacgtattccagtccggcttcgcccagaagcgcgcgcggggcttcggtgacgcccaggccccggcacaggtggcagggggcgtggtaggtcaccttcttgctcggcccggtgaaggactcgtcggtgatgcccagcacgtcacggacaaaggaactgaagtcgatgacccggtgggcaaactgggcggccttgtaggccatggccggatcgtcggcgaaaagccgcttgtagccgtgcttgagataggaggcgcaggaggcgcacatcgtcacgatgtagtcgaagtcctgggcgtcgatggcgttcatgttgtgggcggcaagctcccggccggcctgcttctcgcccatcatctgcagcggcaacccgcagcaggactggcccatggggtactccatggccacgcccggcttggaggcgatgaccgccacggctgcttccatctgttcgggatagacgaagtcctgcacgcaacccgagaacagcgcgactttcagcttggcgtcggccacccggggcttgatgcgctcccacttgtcgcggaaggcctcgtcggccacggccggcagggcgcggaagtcctgatccttgaacaggaacatgggcagatggcgcaggtacggcgtgccgccggtgatcggcttttggagtagccgggcggacttgagcatggtgtggaagagcttgcggtttttgagcacctggcccacggccgtggaatagagcggatggccttcctcgtcctggatgcgggcgtggacttccttgatcagggtcggcagatcgatgccggcggcgcacacggccttgcaggcgccgcagttgaggcagttctggaccagatttttggccttctcccggccgtggaagaagtaggtggcgacaaggccgatggccccgatgtagacgtggccgtatttgtggccgccgaccagacggtagatgggacagacattggcgcaggcgccgcagcgaatgcagcgcagcacctgtttgaattccgggtcacgggccatggccagacggccgttgtccaaaaagaccacatgcttgaccttggttccgcggggagagggctcgcaaggcacagtgccggtgatccaggtgacataggaggtgatggcctggccggtggcgtttttgggcaggcagcggatgatgcgcagggcgtcgtgcagggtcggcatgagcttgtcgacgccggccagagccacatgcacccggggcagggtggtggtgagccgcccgttgccttcgttggttataaggccaatggtgccggttgcggcaatggcgaagttggccccggagatgcccatgtcggcttggcagaatttgggccgcagttcccggcgggccaccttgacgagcttttggatgtccacgtcctgctgcttgtgggtgacctcggaaaacaggtcggccacctgatagcgcgacagatggatagccggcatgaccatgtgggtcgggccttcgtggcgcagctggatgatccattcgccaaggtcggtctcggtcacttcaaagccctgggcttcgaggtgatcgtttaagtgggtctcctcggcggtcatggacttggatttgacgatggtcttgacgttattttctttgccgatgcgggcaatgatctcattggcttcgtgggcggtggcggccagatggaccttggtgccggcggcttcggcgtggcgtttgaattcctggaagagttcctccagacggccgatggattcgtccttggccgcggcgatctcggcgatcagttccggggcgtcgatgtcggcaaaggcattggcccgggatgtgcggtaggccacggcgaaattgtccagggcctggcgctggaaatcgttttcaagtgcttcgcgcaattgcttgcggtattccttgagggtggtggcgtcttgcatctatttgtcctccaagatgaggatgtgcagttccagcggcccatgtacgcccagggccaggacgcgctcaatgtcggcggtgcggctggggccggtgacgaaggcggtgaaatcgggctgtcccatccattcgaccagcctgggctccagggcataggagtcggccacgatggccctggccggcagcacggcgatgtggatctcggcaatcatgctggccaggcgcacttcctcgtttagggagcggatgaccacggtgccggtctcggcgatgccggcggcggccatggtcaggccaatgtcgatgccgccgaggtgggcgcgcatgccggaagtgatgagcttcacgccgcgctcggcgcaatgggccgacagggcggccatggcctcgtcgggcatttccggggcgcagatgattttatcctgcttggtttcgcacagggcttcggccgtgccggaaagcggcgcgtcgcagcccgaggccaggatctggcaggcttccttgccgacgcagacgtcggcgacgtaggccatggcctcgtccatggaagcgacgcagcgtaccgtggccgaaaccaggccggctttcgccgtgagtttttcgaccagattgggggtggtcatgggaacctctctttggggtcggaaacaatacggccggcgacgcgcgcgcgaagccggccgtaccagacgctagcgctaagggttagaggttagggcagcatccacttgagggcataggcctggagcagggtcagcacggcgacgacgccgagcatggccagggagtggggcagggtgaagcggaaaatgtcgccttccttgcccaccatgttggaggccgcggtggccaccgagatggactggggcgagatcatcttgccggtgacgccaccggaggagttggcggcaaccgtcaggtgcggatcgacgccgatctgctgggcggtggtcttctgcagcgaaccaaacagggcgttggaggaggtgtccgaaccggtcaggaacacgcccagccagccgaggatcggcgagaagaacgggaacagcgcacccgtggcggtgaaggccaggcccatggaggagctcatgcccgagtagttcatgatgtaggccagacccaggatcatggcaatggtgcagatgggccacttgagctgcttgatggtgcggaaaaggcaggcaatgcccttgccgaagccgtagcccggcatgaaaatgatggagagcaggccggcgaacaggatggccgtacccggagtggacagcagattgacgttgaacacggccgggtagggcgcgtccttggccacgatgggagcggttttgacgaccagattatgcaggcccggccactcgaacttcatgatgaagatcttgtccaggatggccttgaaggaatcgatgccccagaaaaagaccatgatggccaggatgatgtagggcagccaggcgcggaagatctcgccaccggagaactgggcctcgacggtgcgctgggcggccggagcttcatccgggaagtgccaggtctgcttgggcttccagactttgaggaacagccccagaccgaggatggtcacaatggcggaaatgatgtcgggcaggtaggggccgacgtagttggagaccaggaactgggaaccggcgaagcacacgccggcgatgatgacggcgggcagcacttccatggtgcgcttgaaaccgcacatggtgacggacagccacagcggcacgatgatggacaggaagggcagctggcggccgcagatggcgctgattttcatcatgtcgaggtcggtgaccttggccgcgaccacgatggggatgccgatggcgccgaaggcgaccggggcggtgttggcgatgaggcagatgccggcggcgtacagcgggttaaacccaaggcccaccagcatggcggcggtgatggccaccggggtgccgaaaccggcggtgccttcgataaacgaaccgaaggcaaaggcgatgaagatggcctggagccggcggtcatcggtgatctgggccagggagttcttgatgatgttgaattccccggactcgacggtcatgttgtacacccagatggcggtgacgacgatccagacgatggggaacaggccgaaagcggcgccgtaaatggtggcgtcaatggccaagccgaccggcatgccccaggccgcgatggccaggatgacggcggtgagcgtggcggcaaaggccgctttgtggccggccatgcgtttgaccgccagcatgtagaacagcatgtacaggggaatgcccgccacgagtgcggaaagcccgtagcttccgagcggttggtactgttggacccacgacatgttctctcgctcctttggttggaaagttgaccagccgctcccgatcccgtcgccgcgaagggccggggtgcgagccaaaccgctattggacaggccctcccgaacccggacacgagagtccgggagggccgtgtcggcttacaggccgaggtttttttcagcatcgccatgttgacggactgctgcacgatcttggtgccgtgctcgatgcgcgaacggtcgcgcagcttttcccgggtcagcatgagttccatcttcttggccacggagaaggtgtcgtcgcgcaccacgatgacgggcacgcccttgtcctcggccttggccaggatcatgtcgttggggtagagattgccggtgaggatcagcgccgagcagttgccttccagggccacgagctgcaggtcggcgcggtcgccgccgcacaggatggccacgtccttctggcgtttgaagaaggtgacgaagttctccacctgcatggtgccgatgaggaagttgaccaccagcttgtcgcttttcgggggagcggtgaccaggcggccgcccaggcccacggccagatcggaggcgcgcacggcgaacatgatgggatcgtgaggcacgatgccgagcacgtccacgccccggcgcttgaggaagggcacgatcagggtctcggcctcttcgcggaagtgttcgggcacgtcatttaagatgacgccgacgaggtcgtcgcccagggcttccttggcggcggcaagatagtcgtagttgtattcctggaggtagcggtcgaccaggatgaccttggtgcccagggcctgggacacggacacgccgtccacgccgcagtacttgccggagtagaggaagctgcccgagccgccgaccagcatgaggtccttttcggcggacagcttcttgtagctgtccacgatgcccggcagcaggttggcgcagtcttccaggaaggcgcgcatccggaagtcgcgggtgatgaccaccggggtcaccagggagggattctcggacaggcccagggcctgctgcatgaaataggcgtcttcatcgccgatctggttgccgatcttatggggaaccgcgccgatgggcttcatgtagcccacgcgctggccttcgcgctggaagtgctgccccagggccagggtgacgaggtttttgcccgagtatccctgggtagacccgatgtagagaccgatcataggtatgttcctcctgggttcgttttaggcggaaagggtgatgcgcacgtcggccaccacggccttctcggcattgaccagcaccggattgaattcggcttcgacgatttccgggaaatccagggccagctcggacatggtgatgaggatgtcctcgatggcctggaagttgacgggctgttcgccgcgcacgcccttaaggagcatgtaggacttgatctcccggatgatgcccttggcgtcgtcgcggcccaagggagccaggcggaaggcgatgtccttgaggatttccacgtagatgccgcccaggccgaacatcaaaagcggcccgaactggtcgtcgcgcttgaacccgatgatgatttccttgcagcccttgggggccatctcctggaccagacagccggcgatgtaggcttcgggccgcatgcgctgggcccgggccgtgatgtcaaagaaggcgttgcgcacggcttcggcatcggccaggttcaccttgaccccgcccacgtctgacttgtgcgagatctggggcgaggcgatcttgaggaccacggggtaaccgatcttgtcggcggcggcaacggcttcgtccgaggagcgggccagtccggtgttgggggtgggcaggttgtaggcgcgaagcacttcctgggcctggaattccaccacttcggtggcgcccttggaccgggcctcgttgatgaccagccgcgctttttggcggttgcgccggacttcggggtactcctgggccggggtctgccgccacaggtagtagttgtacatggtctcgatgctcttgatcagcggctcggggtagatggagcaggggatgccggcgtcggtgagcatcttctggccggggcgggtgcgctggccgcccatgtagttgacgaagatgggtttcttggtcttcttcgaaacctcgatgatggcttcggccgtctcgatgatctcggccgaggccgtgggggtcaagagcaccaggatggagtggacctggggatcgtcgatgaccacttccagggtcttgcggtagcgctcggccggggcgtcgccgatgaggtcgacggggttgtagagcgacgcgtagggcggcaggaattccttcatgcgttcgatggtggaatttgacagccgggccatgttgaggctggacttttccgtggcgtcggcggccaggatgccggggccgccggagttggtgacgatgcacaggcccggcccctcgggcaggggctgggtggagaaggcctgggccaggtcgaacagcgtggccatgtcattggcccggatgacgccggtcttgcggaaggcggcggtgtaggcctggtccgaaccggcgatggcgccggtgtgggaggaggcggccttggcgccggcggtggtggtaccggacttgatcatgatgaccggcttttcctgggtgaccttggcggcctgctcaatgaagtccgcgccgtgctcgacgttctcgatgtacccgagaatgaccgaggtgttggggtcggtgcgcaggtactccagcatgttgccttcgttgatgacggctttgttgccaagggacacgaacttggagaacccgacgttttcgcccagcgcccagtcgagaatggcggtgcacagcgccccggactgggagaaaaacgcgatggagcctttttcggggtagccggcggcgaacgaggcgttattattgtcgtgggtgctgataagccccaggcagttggggccgaccatggcgatctcatgctcggtgcatagttcgatcaggcgctgctccagggcatagccttccttgcccacttccttgaagcctgcggtgatgatgacggccgagcgcaccttgcgcttggccagggcttccatggagggcacgacggcggccacgggcacgacgatgacggccatgtccaggccttcgggcaggtcctcgatctttttggtgaccggcaggccgaggatctcgtcggccttggggttcacggggatcagcgtgcccttgtacccggcctccagcatgttggccacgaccgtgtggccgaccttgcccggggcggcggaggccccgatgacggctacggttttgggcgcgaacagcgcgtggatgttgtctttcaaactcattcggctacctcgctcgccaagttggttgtgtgccggatcagcggccggccagggtctccgcgtagatttccaccggatgcctgatggccagcgtatcgccggcctgtgacaacatgtcgcctatctggagcatgcaggccgggcagctcgtggccgccaccgtcgcgcccgtggccacgatgttgtcccgcttgcgcttgccgatacgtttggacaggtcgtaatgctgcagcgtgaagctgccgccggaaccgcagcaggaatccgcgccgtccatttcctggagtttgtaacgcggattgcagccgatcagcgcccggggttcggcggagacgcccagggactttttgaggtggcagggatcgtggtaggtcacggtcaccggctcgccggaaacggcgacgtcggccggcgtaacgcccacgtcctggatgaggaaggcgctgatgtccttgaccttggccgacagttccttgacctggtagcgggtcgtggccggcagatcctcggccatcaggggccagattttcttgatggtggaggtgcaggtggcgcagggcgtcaccagcacgtcgaagtcggattcggcgaagaccttcatgttgagggccacgagcttttcgaaggtctcgcggtcgcccgaggacagggccgggatgccgcagcaggcctgggcatggggcatgaagacgccgacgccgtggtggtcgcagaccttaaggaccgcttcgccgatgcgcgggaacatcttgtccaccacgcagccgtagaaaaacgcgatcttcaggcccgagtggccgcgcggggtgtcgcgctgcgtggcgacgtcatgcaacggcttgtcggccaggggcgcgaagtggcggccgccgatgaggtcggagaagacccgggcgcaggacgaacccagcatgtcgttgaccggcttggtgaaaagcccctggaacttggaggccacgccaagcacggtgtcgaagagcttggggttttgcaaaaggccccggaaaatggctcgtttgaccggggggaggccgtagtagccggtcaaaaaggcccgggccttgaggaagatgtccagggccttgacgccgcttggacagttggcctggcaggagccgcagagcaagcaagcgtccaggcgttccttgaccccggccgggtccttgatgacctcgtcggccaggcattcaagcagggcgatcttgccccgggccacatgtccctccaggccagtctcggcgtagatgggacacacggcctggcacatgccgcagcgcatgcaggccacgagctggtcatcgatctgtttgagcagcccaacgagctgtcgcatctcgctcatgttaggcccccgtgatcttgcccggattgaggatgttcttgggatccatggcggcctttaagcgcttggcgtacatgatggaaccctggcccacttccttgaccatgtacttggacttggccatgccgatgccgtgctcgccggacagcgtgccgcccagggacagggccacgtcgaagatctcgtcgatggccgcttccacccgggtgaattcggcgtggtcgcgcttgtcggtgaggatggtgggatgcaggttgccgtcgccggcgtggccgaaggtgccgatggtcagcttgtacttctcggcgatcttctccagcgccccgaccatggccgggatcttggagcgcggcacggtggcgtcctcgagcaccgtggtcgggcgcacccgggccagggccgacagggcggcgcggcgggcttcccagaccttgttgcgttcgacggcatccttggccacctggatgcgggtggcgccgatgcgcttgcagatggcctcgacttcggcggcttcgtcctcgacctgggccggatggccgtccacttcgatgagcagcagggccttggcgtcggtgggcagcccggcgtgggcgaagtcctcgacggtcttgatggtgaagtcgtccatgtactcaagggtcgccgggacgatcttggcggcgatgatggcggccacggtctccgaggctttgcccaggtcgtcgaagatggccatcatggccttgctggccttgggcggcggcacgagcttcaagatgatctcgttgaaaacgcccagggtgccttcggagccgaccatgaggccgtggaggttcatgccggtgacgcacttgacggtgcgcgacccggttttgaccagctcgccgtccacgtcatagaagctcatgcccatgacgtagtccttggtgacgccgtacttgaggccgcgcagcccgccggcgttctcggccacgttgccgcccatggtggacacggcctggctgcccggatcgggcgggtaaaaaaggccccgcttggccacctcggcggcgaacttggccgtgaccacgccggtctggaccacggcgtacatgtcggcttcgttgatctcgatgatcttgttgagcgcaccggtcagcaccaccaccccgccttcggaggggatggtgccgccgcttaaattcgttcccgagccgcgcacggtcagcggcagcccgagctcattgcaggttttaaccacccgtcccagagcctcgggcgtctccggacgcacggccagggccgggagctgggggggaaggaccgccgcgtcgtaggcgtaattgtggcggtccacctcgctggccaggacgttgcccgtgccgacgatttcctcgaacttctgggacaggtggttgctcatcgtttttctcgcttggctacgttatttgccggaacggccttcgtcgcacgggtcaccgttgccgggacgggcgtgttcggcggtggaagcggcggcgcaaaaggccgggtcatcgccatgggcagcctcgccggcagcggccggcgcgtcgaagaccggcatctcggccaggtattgcagctgcttgaagcgctccatgtaggattgctccatggaggcgcggtatttcttggacagttcgggatgcatcttttccagggcggcgtagcggacttcgccggccaaaaagccctggaagtcgccggccggggccttggagtcgatggtcagcgggttcttgccctcggccttggcgtcggggttgtagcggaacagcggccaatagccggtttccacggccagcttggcttcttccatggacttgcccatgccctttctaatgccctggttgatgcagggagcgtaggcgatgacgatggacggtcccttgtgggcttcggcttcgaggaaggccttgagcgtctggttcttgtccgcgcccatggccaccgaggccacgtagacgtagccgtaggtcatggccatgcgggccaagtcctttttgccggtcatcttgccggccgaggcgaacttggcgatggcgcccagcggggtggccttggaggcctggccgccggtgttggagtacacttcggtgtccatgaccaggatgttgatgtcctcgcccgaggcgatgacgtggtcgaggccgccgaagccgatgtcgtaggcccaaccgtcgccgccaaagatccacacggacttcttggtgaagaggtcggcgtcggccaggatggacgcctggaccgggtcggcggcggagagcagggacttcatctggtcgccgtactggcgggaggcggcggcgtcgtccttgccggccagccagccggccagggcggcgcgcagcgcgtcggagaggctgccttccagggcggcggccaccttgtcggccagcttgtgacgacgctggaccagggccatgttgtagccgaagccgaactcggcggcgtcctcgaacagggagttgttccaggccgggccgtggccgtcggcgttgacggcgtagggagcggtgggagccgagccgccccaaatggaggagcaacccgtggcgttggccaccatcatgcgctcgccgtaaagctgggtgaggagcttgacgtagggggtctcgccgcaaccggcgcaagcgcccgagaactccagcagcggctggtagaactggctgcccttgaggttttcgcgcttgaccagggaacccttgttcttgagcttcatggcgaagccgtggttggggacctgctcggcggcttcggtctccagcggcttcatgacgagcgccttctgcttggccgggcagacgtcggcgcaggagccgcagcccatgcagtccatggggaagacctgcatgcggtaggccaggcccttgagctccttgccggtggccggcagggtgtcgaaggacgccggcgcgccggccatttcggcctcatcggccaggaagggccggatggtggcgtgggggcagacgtaggagcactggttgcactggatgcagttttccttgatccagtgagggatgtttatcgccacaccgcgcttttcatactgggcggtggccgtcgggaaggagccgttttcggcaaaagccgaaaccggcacctcgtcgcccttctgggccaggatggggcggatgaccttgttgaagtactcgggttcgtcgatggcggcggccggggcgtcggcgacgctggcccaggcggccgggacggcgatctcgaccagaccttccatggccatgtccacggcgtcgatgttcatcttgacgattttttcgcccttgttgccgtaggtcttcttgatggagtccttcagcaggctgatggcttcctcgatgggcagcacgccggccagcttgaaaaacgccgtctgcatgatcatgttgatgcgcgcgcccaggccgactttggcgccgatagccacggcgtcgatgttgtagaccttgatcttcttggccgcgatggtgcgcagcatatggccgggaaggtttttctccaactcctcggcggtgttccaggaggagttcagcacgaaggtgccgccgtccttgatgccttccagaatctcgtaggtgttgacgtagctgggcttgtggcaggcgatgtagtcggccgcgtcgaccaggtaggtggactggatgggctttttgccaaagcgcaggtgcgacacggtgatgccgccggacttcttggagtcgtaggcaaagtagccctgggcgtagaggtcggtgttgtcgccgatgatcttgatggccgacttgttggcgccgacggtgccgtcggagccaaagccccagaacttgcactgcacggtgccttcggggaccgtgggcagcacgccggccgagggcagggacaggccggacacgtcgtcggtgatgccgaccacgaagtggcgcttgggcgcggcggcggccatgttgtcgtagatggcctggaccatgccggggcggaattccttggaccccaggccatagcggccggtcatgagcttggggatggagccgccgcgttcgacgtaggccgagcagatgtcttcgtagagcggctcgccgaggctgccgggctccttgcagcggtcaaggacggtgacgaccttggccgaggccggcatgaccttgaacagatagtccggggcaaagggcctaaacaggcggaccttgaccaggccgaccttttcgcccttggcggtcaggtagttgaccacttcctcgatggtctcgcagcccgaacccatggccacgatgacgcgctcggcgtcgggggcgcccacgtagtcgaagagcttgtaagggcggccggtgacggcggcgaccttttccatctgggcggccacgatgccgggcagcacctgatagtaggggttggagcgctcgcggccctggaagaatatgtccgggttctgggccgtgccgcgcaggtccgggtgctcggggttcatggcccgggcgcggaaggcggcgattttgtcgtggggaaccagggccttgatgtcctcgtagtcgatgacttcgatcttctggatctcgtgggaggtgcggaagccgtcgaagaagtggacaaaggggacgctcgattcgatggccgagaggtgcgacaccagggccaggtccatgcactcctggaccgaggccgaggccagcatggcgaaaccggtggagcgggcgctcatgacgtcggagtggtcgccgaaaatcgacagggcgtgggtggcgatggcccgggccgacacgtggaagacgccgggaagcagttcgccggcgatcttgaacatgttggggatcatgagcagcaggccctgggaggcggtgaaggtggtggtcaacgcgcccgcggccagggagccgtggaccgcgccggcggcgccggcctcggactgcatttcgcggatggtgacggtctggccgaagatgtttttaaggcctttggccgcccactcgtccgcgatctcgcccatggtggacgagggggtgatggggtaaatggccgccgtatcacttaacgcgtaggcgacgtgcgtggtggcggtattgccgtccatgctcttcatcttcttggccatgctgctgtctccttaaaggttgtcgttcgaccgaatgggagaaggccgggtcgaccctgccgcattcgcaagtcgtgtgccatcacggcaaaaagcaagaattccgatgaattgccgacaagatacaaccgctccgggtccaggcgggtcgccgcatccgggaaatcggatggggcttcaggggctaatagcctgaaatgtatgacttcgtaaagcgttgctccaaaggcggtcagtctggtttttcagacacgatgtttgagtctggtttttcagactcaacgcctcaggccgcgccgcgccgggacaggggagttcaaccccttccgtgccacagacaagggtttttggcacgtaaaaagggctgaaaatgactttgttccaaaagtcccaaggaggcgagaaactctattcagacttgtgtagtctggaaaaggggactcggctgcgccacggcgaacaatggcaagacgttacgcccaggcgacggcagaccgccggatgaaccggacgtccgggcgcgagccgggcgtttggcaggggacggcaagaaatcggatgacggaattctgaaaaccgatttttgagcaaaattgtgcccgatttctcaagctactccccggccgcgtcctggtcggggacggccaggacgttttttttgagcaaggcatagaagtgggaccgcgacaggccggatatttccaccatggcggccacgtcgcggccgtgttcggccagcaggccttccagatagcgccgctccatggcttccttgtattccttgagggtgcgccggcccacgggctccaccggccggccaaaccccgaggccaggggcgacacgggcctgttgcaggattgcatcccgcgctccagggtggacttggtcaccttgatgcgcacgtcctggggcaggtgcatggagtagagggttttttcccggcccgaggccaaaaaggcccgctccacgacgtttcgcaactcgcgcacgttgcccggccagtcgtaggcttccaggatggccatgaattcggcgtcgaagcctttttggggcagggcgtattcggcggccagggcgtcggcggcggccagggccaggggtttgatgtcttccacccggcagcgcaggggcggcagggccagttcgatggtctttaagcgaaagtagaggtcgcgtcgaaaggtcccggcctcgaccatggcggccaggtcgcggttggtggcggcgatgaggcggaaatcgctgcgcagttcctcgatgccccccaccggccggaaggtcttttcgtggagcacccgcagaaaggtcttttggagagacagcggcatctcgcccacttcatccagaaacagcgtccccccgtcggccaggcgcaccaaccctacccggtcggcgtcggctccggtgaaagcgcctttcttgtggccaaaaagcgtgctctcgaccagggtttcggtgagcgaagcgcagtccacggtgacgaagggcttcttggcccggccgctgttggcgtggatgaggcgggcgaaaagctccttgccggccccggtctcgccagtgaccaaaacggcggcggaggcggcggcggcccgggccacctggtccagacagggctgcatgcgagggctggcggcgatgcagccggaaaggctcaaggaaaccggcgcgccgtggtcgccccggcgctcctcgcggtatttgagcgcccgcttgagggtcagcatgatctgcttgatgggcgagggcttgaccagatagtcccacacgccttcctggatggccagttccgcgccgtcggggtcgcccatgccggtgaggatgatgacttccggcgcgtcgggcaggcgcttgatggccggcagggcggccaggccgttgccgtcgggcaggcggacgtccagaaagaccacgtcgaagctctcgcgggcgagcagttccatgccggcctccaggccgccggcggcttcgctggtcaggcgcatcttgcgcgtgaggcttataatggtgtcgcggacctcgggatcgtcgtcaatgatgcaaacggatttcatgcggctatcgtctggggtttggcgtcgagcacctcgcggatggccgccgagatgatcgcctggttgtagggcttgagcacgacctttttgatgttgccggccagttcccggtcctcgatgtcgcccatgcggcccgagacgaggatgacgggcaggcggggggcgatctcggccacctgtttggccagttccaggccgttggcgtcgggcatgtcgtaatcggtgatgaccacgtcgaaggcgtcgggagcctcggccagggcggccagggccggggccgccccgggtttggccgtgacctcgtggccgagttgggccaggacgcgcgggatggtcaggagctggtcctcgtcatcctcgacaaaaaggatgcggtcgcggcctcggttggcggccggacgcggcgcggcggccggcgcgtcgccctcgtcgagcagcggcaggaagatgtcaaagacggtgtgttcgcccggggcgctcgttacccgcacgccgcctcggtggctcttgacgatgccgcgcaccacggccagccccaggcccgtgccttcgtttttctgcttggtggagaaaaacggatcaaagatcttgtccacgatgtcgccggcaatgcccgggccggtgtcggccacggtgatgcgggcgcaacgtccggcccgcgttcccacctgcccagcctgatcctcgtccaggctgtcctcagtcagcctcagggccaggacaccgccagtgggacgcatggcctggaaggcgttggtgcacaggttcatgacgatctggtggagctgggtggggtcggcccggcaggccacgggcgcgtcaggggtttccaccacgattttgatgttgcgcggcagcgaggcccggatcagcccggccgcctcgttgaccacgtcggccacgttgatgggcgcgaacccggcctgggacgggcgagtgaaggagagtatctgcttgaccagccggctgccgcgctcgccggccttgagcacccggcgcaggtcgtcttccatgggatcgtccggggccatgtccatgagcgccagctcggtggaattgatgatggaggtgaggatgttgttgaagtcgtgggcgatgccgccggccagggtgccgatggcttccatcttttgcgactggagcagctgtcgctccaggctgaccttctgggtcacgtcctcggccgtggacaagacgccgaccacggcccccttgtcgtcgtggagcggcaccttcttgatttccagcagcacgtccaggccccggacgttgcgggcggccagctccccggcgacggggcggttgtggtgcatgacgtcgatgtccgtggcccgcacggcgtccacgtcctcggggcgaagcggcaaggcggcgtcgtcgcggcccatgaggtcggccaggccgtcaaagccgaagaaatcgatgaaggcccggttggcccccatgtagcgcagggccttgtccttccaggaaacgagctgggggatgttgtccaggaccaagcgcagcatttcctgggattcgcgcagggcccgctcggcctcgtggcgcttggtcacgtcctccaccacgccctcgacaaaggccagatagccctccgggtcggccaccagccggatggtcacgttggccgtgacctggcgggcgtcgggccgcacgaaacgggtctcgaactgggccgtggcgtcctcgtccacggccgagtcaatcagcgccgtaaagcgctcccggccgccgaaaagcacctccaccatgtcgccccgtcggcgcagcaaggtatcgagatcgtcgacgccgagcatggacagcatggccgggttgacgtccacggccgcgccgtcgggggtcatgcggaagatgcccagggccgagttttcgaagatgccgcggtatttctcctcggccaggcgcaggcgctcggcggcacgcttgagttccgagacgtcgtagagcacgcccacaagcccggcgatctgtcccttggcgctttcgtagacggcccggtgcaggatgaccgagtggggcgtgccgtcggcggcttcgatgtcggtttcggccatgcgcacgccgggttcgcgcaaaagcccggcgtcttcggcgtcaagggcgcgcgacagcggcgaatcggccactccggcgcaggcgtccacggtccggggatcgtcgcccgcgccgcaaagcgcccggaaggccgggttgcagccacggtattgcccggactcatccttataatagataggaatggggatggtgttgaccagggtttccaggaacgacacctgatccttgattttttcctccaccgagcggcggcgcaggatgttggtcacgagcaggaccatgacgtagcacaggatgagcaggctgatgatgatggtccagaagaccgcgatgttgatgtggtagaaggggtaaggttcgtttatgagcgtaaagccggtaggcagtttgtccgtggtgatgcccaggcgcagcatctcgcggaagtcgaagataaacgtgtcgttggtttttgagacgatgggcagctcggccacgggcgtgccgtgcaggagcctgtcggccatctcggcggcgatgcggccttcctcgaaaccgctgtgcagccgcccgccgacgatgccgtggccgagcatgaactgccaggcgctgtagatgggcacgtcggaattggcccggatggccgagaggacctcgttgacggaatagacgtccttctcggtgtccttgtaaaaagggatgagaaagatcatggcctcgtcggacagatcgcggacccggccgaggatgccggtcagcgtcaggttgtcctcgtattcgaaggtgagccggccggcgaagtccggctccacggcccgcagctggttgccgatggccacgcccgtcaccgaggtgtcgccgaagatgacgagcttgtcgcggccgggatgaaagcgcagggccagttccagggtggtcttgatgtccgggttttccaggacgccggtgaagttggggtggccgtcgagccaggcgggcttgaagtcgttgacgccgcaaaagaccaccggcgtgccgggaaacagttcgtcgtggtattcccgcaggaagtcgaaggcgtagttgtccgaggccaggatgacctcaaagcgggtgttgcggtacttgagcttgtagaaatcgtggagcatggcccgcagcacggggtcggcgtactttttcgagtccatgtactcgatttgcaggtccacgttgaagtccgaggcggcgaaggcttcgcgcacgccggccaggatctcgtcggaccactggtagccgttttggtaggcattaaaaaacaggacgttcttgcggatcttctcagcccgggcagggctggccagaaccagcaggagcagggcgaggcaacaaagaagccttcgggccatggggactcgcgagggaaaaagtgtcgggccgcgcggcccggggaatgtcgtttccgaagtttgtcatggccggcccggaagtcaaggccttggcccggctccccttggcggcgacggattgggtgcggattgcggccttcggcccaggccgccgctgtggctacagcgggaaaggatgtcgccacgcgtgtcgccacgcaagagttgcttccagggagcctaaaagttatactttttggccgcgccgtccggcgcgcccggtttgccaaccccctttcgcacagaaggaccacgccccatgggttttttttccaagctcaagaaattctggacggcggacaacgccccggaagccacggttcaacccgccgccgaagctccggccgaggcttctgctccggttgacgaagtcgcgcctgtcgccgccgatgcggcagcatcgtctccggctgccgagccgtcagcccaggttgccgctcaacccgcgaccgatcttgcaccactcgccgcgccggaaccggccgacagcacgtcccagcacgaaccggcctccggccgggaacccgttgccgcgccccagacagcggccccgatgccgcatcacgatgtagtcgatgcagagccttcgtctgaagaccggccggccccccaggccgaagcaacgccggccatccagcctgacgttcctgcatccgaggccgaaccgctggccgggacggcctcgacgccgcagccggaacccacgtccgaaccggctcccgagcctgaatcgaagccggctcccgcccccgaggcgcaggccatcgccgccgtggccgaacccgttgtctccacgctcaagccccagcctgtcgccgcgcccgaaccgacttccgtcgccccggctccggccgcccccgccgcagccgaggacgcgccgtggcgcaacgccctggtcctggccctgcgccaggccgaacccaagctgtccgtctggctcgacgtgctgctggccgacgtggacgtggccgggccggtcctgtgggaacgtctgcgcttcctgttcgaaagtctggaagcgccgagcgccgaggccgacgcctttgtcgccaagttcgccgactgggtggcggtcatggagtacgacgaggtggagctgttccgctccgaactccagtaccgcctggccctggccctggacctcgaagacgaggaagacgagcgcaaccggcttttcctcaagctctccgaagggctggccaagaccaaggaacagatcgtcaagcgtatcgacggcctgctcggccgccatgccgtcattgacgaagccttttgggaagaactcgaggaaatcctcatcatggccgacgtgggcttcgagccggcggccaagctgctggacgccctgcgcgacaaggtcagaaagcgcggcaccacagatccggccgtgttcaaggatatcctgcgcgaggagctggccgagattttccgcacccccaagaccatcaaggccatcaatccgcctgaagtggtcatgatgatcggcgtcaacggcgtgggcaagaccactaccatcgccaagctggcccaccgcgacatgatgcgcggcaagaaggtgctcatcgccgccggcgacaccttccgggcggcggccatcgagcagctgcacatctgggccaagcgcgtgggcgcggacttttacagcaagggcgccaacgccgacccggcggctgtggccttcgaggccatggacaaggccctggccgagggctacgacgtggtctacctggacacggccggccggctgcacaccaagaccaacctcatggaagagctgcgcaagatccaccgggttgtgggcaaaaagcatccgggcgcgccccaccgctcggtgctggtgctggacgccaccaccggccagaacgcgctgtcgcaggtaaagcttttcggcgaggcggccggggtggacgagatcatcctgaccaagctcgacggcacagccaagggcggcgtggtggtcggcattgcgctgtcgttctcggtgcccatcacctacgtgggccttggcgagaaaatggaagatctgcggccctttgacggccaggatttcgcccaggcgctgctcggggtggaatagcggcgcagcccgcatttccccacggacaagggccgcgcggtctcggcttatgccgaacaaccacgcggcccttattcccgctcccagcccccttttaaccattcggggggtctgggggcctcaggcccccagccgccggaggcctcttccctcttctctgctctcttgtcctacccaatccacccttcgatttcctggcgcgtgggcatcttccccgccgccttgaccgcgccgtcgatgaccaggcccggcgtcacgaagacgcccagcatggcgatctgctgcagatcggtcactttttccacggtcgcgtcgcagcccttggccgccaccacgtccttgaccagcttttccagctcattgcacttggaacaccctgtgccgagcacctgaatcaacatggattggctccttgtcggcggctatttctggcagccgcagtcgatttttccggccacgatgtcggctacgtcgcccagcacgtcatgggtccagcagtcgtcggcgccggccgcctcgcgcatgaccagggccaggatgtaggccagctcctgcaggctggctccggcgtccagcgcccccttgaagtgcttgagcacgcagggcttggaccgggccttgaccgacaccgcgaagcagatgaactggtaggtcttctcgtcgatgagccgcttctcggcatacagcgcgtccatctcgtcgagtttcgccgcaaactccgggaacagttgggccaggaaacgcatacaagtctcctacaggatcaggttgaagacatagcctacaatgaggatgccacagccgacaatgccggcaaacgccagcaacaaaggcggtttgaggaccttgcgcaaaatcaccatctccggcagcgacaaggcgatgacggccatcatgaaggccaacaccgtgcccagggccgcgcccttggacagcagcgcctccaccaccggcacgatgccggcggcgttggaatacatgggaatgccgatcaacaccgagaccggcaccgaccaccagttggtttcgcccatgatgccggccatgaagccctcgggcacgtagccgtggatgccggccccgacgccgatgcccagaagcacccatttccaggtgcgccccaggatgtcgcgcacggcctggatggcgtaatcgatgcgcccgtcaggggtaaggtcggtggtggacgcatcgccgccaccggcccggatggccagcacccagtcctccacgtagcgctccagattgagccggccaagcacccagcccgagaccacggccacggccagccccatggccatatagagcgccgccaccttccagccaagcaggccgtagagcagcaccaccgcgatctcgttgaccatgggcgcggacacgaggaaggaaaacgtcacgccaaggggcacgccggccgagacgaagccaataaacagcggcacggccgagcaggagcaaaagggcgtgacgatgccaagcagcgcggccatgacgtttccggcggattcgcgtttgccggccaggatgcggcgggtgcgctcgggcgtgaaaaacgagcggatgatgccgacgccaaagacgaccagggtcaggagcatgagcaccttaggcgaatcgtagaggaaaaactcgatggaatcgccgaggtgcgacccgcgtgtaaggcccatgacgtcgtaggtgaggaatttcgagatgccgagcagcttgccgtaaagataaaaccaggcggccaggccgacgccccccaggaccaggcggcgcggcgagggccacacccggcccgtggccgccacttgttccggatcggtcccggcgcaggcgcaggcaacttgtacagctttttcatcgtgttgcatggttgaaactcccggccggaggcggccatgatttgctatttggtcaaaaggcaaaatagcaacattgccaacggccggcaagtgggattttgcggctctgttgtaggaaaatgggagaggggaaacgagacgacgacgggcggtgggaagcggacgaggcgtcgccgcaacgtcggcgggcttggcctgcgactcgccacaatagatgattttcttggctttccagtgcgctagcgggatccttgcccgaattccgcggcaccacggcgaggagggaaaagagcaatcggacggcagggagcccgcgcgtctagaccgggccggggagcgttccccggcccggcatcaccgccggcctagagctttatccacttgcggcgcagggcgttgtcgagaatgacgccgaccacgaaggccacgcccatgtgccacatggcaaatcccgccaccacgatcatggtgtagaattcgtcgcgcttgttgccgatgtcgcgcacggtgacggccagttcggccccggccaaaaagaggatgacgccgaggatggatggcgggaacatcttgaagatgacggccacggactggctgaaaaaaagtgcgatgacgatgacgatggacccgaggatgaccagcgacccgcccgtgcgcgcgccgaaacgcacgtgaccggccatgccgcccgcgccgtggcacatgggcacgccgccaaacagcggcgaaatgatgttcatgacgccctggcttatgcacatggtgcgctcggtgacgggccggtccgggaacagctcgttgttctcggcggcgatggccaccacggcgttgcccaacgttagcggtatctgcggcagggtgaacagcagcgtgccggtgacgatgtcgctccaggtcatctggtgcaggccgaattccggcagccgaaagccgatgctcacctgggtcagctccgaccacagggccggattgccgataagcgcggccacgacgccgataagcagcaacacgaacatggccggaattttcggattggagagcaagataatggtgacggtcagcccgatgccggccagcaccggctcggccaccatacggtggatgccctccaccacaaacgacatgccaaggccgagcatgatgccgcgcaccacgggcttggtggcgagcttggccacgtagtcgatggtgccggtgaggccaatgatgagccagaacagtccggtggtcaggccggaaccgaaaagcgccgccgggctgatgccgccggccacggcggccgcgccgatggccttcatgggctggatgggaatgggggtcttgtagaacagcccggccgcgatcttccaggcgccgaacatgaagagcaggcccaggggatcgatcccgaggatggtgatataggccacgacaaagggaatgagtgtgccaatgtcgccaaacgcgccggcccattccatgtgatcgtagcggttgcgggttttttcgccggccgcctggccgggggccgtttccagaacctcttgtgcctgcgcgccgtcgttcatggtggtgccgccttgttgcacggtgtggaggcaagcccgccgggccgatccggtccgggccggtatcctatcttctatgacacggattttagaaaatacgtgttaccaaggcaagataaaaaagtcccacaggcctcctcagcgaccggagtgctgacgcaagtctttgagataaatgatttgttcttcgatttgttgcgcaaagaaatgttcaacgcaggacaggaaacccgtgacgcagcccagtcgtagggaataataaacgctggttccccggcgttcgtcggccacgatgccggcttctttgaggatgcttaaatgcttggagaccgtggagacgtccgagccgacaagatcgcgcaactcgcacacgcaaagcgcgccccggcccagagcttcgaccatgagcaggcggctgggatgtcccagggctttgaagaccttggcccgtcgggccacatcggcaggcggtttggtcatggggctcctaaaactctcggctctcgtcataggtacggacctgccgccaggataccggggcaggcgttggccagaaaaccataaggcagggacaacgtggactgaaaaccactcagggggttggaaataacctgcaatggcggaagcgtataggagtcgaacctacctgcgacctcgcgaccgcacaccggatttgaagtccgggcgccacaccggtgacgaaacgcttccacgtgagccaggatctgtaccaccttttagccctggtttcaatccttgcccgggattgctcccgcgtggcagcggcgtcacgacggttgtggtcgggccgggcgttgtggcaaaagaagggttcgcgcccgccggatttcttccgggcgctggagcaaccccatgagcgcaacgatcccgtccgaagtcaccttgcttgaacgccgccgcattgaggcggccatgctggccgacgtctacgccgtcctggtcgaacgtatgggccgcgccgccgccctggctgtcatcgaggacacggtggctcgggccgccagggccgccggccaagccttcgccgcccaggccccgggcgggccgaaccttgcgcatttcgccacggtttcggccatttggcaacgcggcggggcgcttgagattgtcaacgaacagcgcgaccccggccgcgtgtccttcgacgtcgcacgctgccgctacgccgaaagctaccgggaaatgggcctgcccgaggaattggccgtacgcgtgtcgtgtctgcgcgacgccgcctttgccgccggctacagcccctgtctgaccctggatcgcccggccaccatcgcctcgggcgcggaaaaatgtcctttcaccttcacctggaatgacgcatgagcatacgccgcaccaccgtcaaggccgccctggaaagcccgtccccctgccccgaaatccgcgtcatgggttgggtgcgcacccgccgcgacgccaagggcttttcctttctcgaattaaacgacggctcctgcctgggtaatctgcaggtcatcatcgacgacacggccgagggcgcggatctggtcaaagcgcttggcgtcggcgcgtcggtggccgtcacgggcgaactggtggcctcaccgggcaagggccagcgctacgaggtccgggctgcttcggtctcgcttctaggagccgctgacccggaaacctatccgctccagaaaaaacgccattccgacgaatttttgcgcaccatcgcccatctgcgcccgcgcaccaacaagtacggcgcgatgctgcgcatccgtgcggccctggcccacggtatccacgactatttcgccaaggaaggcttcgccctggtccacaccccggtcatcaccggctcggactgcgaaggcgccggcgagatgtttcgggtgaccaccctggggcccgaggccgccgcgctgccggtggccgagcgcctgagccaggattttttcggcaaggaagccatgctcaccgtctcggggcagctctcggccgaacccctggcctgcgccctgggccgggtctacacctttgggccgacctttcgggccgagcattccgacacctcgcgccatgccgccgagttttggatgctcgaaccggagatggccttcgccgatcttgaagacaacatgaacctggccgaatccctggtcactcatctggtgcggctggtgctggccgaatgcgccgaggacttcgggcttttcgccaagttcgtggacccgaccctgcccgccaccctggagaatctgctggctgagccctttgtgcgcctgccgtacgtcgaggccgtggacattctcacgtcgtgcaaaaaggctttccaatatccggtggccttcggggccgacctgcaaagcgaacacgagcgctatctggccgaggagcacttcaagcgcccggtcatcgtgtatgactatcccaaggacatcaaagctttttacatgcgccaaaacgacgacggcaagaccgtcggggccatggacgtgctcgtgccgggcatcggcgaactggttggcggcagcgcccgcgaggaacgtctggaccggctggaagcccgcatcgcggaattgggcctaccccttgaggcctattggtggtacctcgacacccggcgcttcggcacggtgccccacgccggcttcggtctcgggttcgaacggttggtcatgcttgtcaccggcgtcaccaacatccgcgacgtcatggctttcccgcgcacctggcggcatctggagttctaggtccgcgttcttgatcaaagaagcggtgaggcgcttttcactggcggacgatcatggtttgtctggttgcgccagcctttttaatggctcacggcggccggccgacgcgtctcccggcagacgcgggacgtgatggcgaggagcaagacgcaaaagcttcccagtgcgaatgacctcccgaacgcaaaccacggcggcccatctttccttaggggaaggatgggccgttttattgaggcggcaagggatgttggctgcgctgcgcgagctgcttcacatgctgccccgaggactgaacaaggaggcgagcgtagcggcgcaggtccgtcagagagcatggcgggtgtcggtgggctggccacgagggcaagatatgctggattgaccgtgttgcgttgttccgaatttttcgttatgaaaagaatttaagatattttgtcatgcagcttgcgtcgcggcgaactgcggacggggtagatagaaatgctgtcatcgggagcgacgaatggatacggtcgagttttcccttgtcgtgccctgctataacgaagaagatgtattgccgcattttcaagcggaagttattccggctcttgatgcggccttaggagccgactgggagatcgtttttgtagacgacggcagcctggatcgttcacgccagctcattgtcggtttgcatttgcacgatccgcgcataaaaggcgtgtttctcagccgtaattttggtcaccaggcagcggtcgatacaggccttagtcatgccaagggacgtttcatcggcgtgatggattgcgatctgcaagaccctgttcaggtcttgttgaacatgtacgccaaatgcaaatccggggtggatgtctgctacggcgtgcgggccagacgcgaatccccctggctgctcaagtttttttactcgtttttttacttgatcatgcacaaggtagccacccacgactggccccgcgacgccggcgacttctgcgttgtctcacgcaaggcccttgatgcggttctcgccttgccggaaaactcccggatgtttcgtgggctgcgttcctgggtcggctttagacagctggggttgccctacgaccggcccaatcgtcgctcgggaaaaagtaaatacaacctccgcaaactcattgatctggcgctactcggcttcgtcggcttcaccgattttcccctgcgcttcattggcgtttttggttttgccgtgggcctgtttgcctgcctgctcatgttcttcgtggtgctcaaccgattttttccccagttttccctgttcggctactgggtcggcgtcagtcccgtggcgacgacaattctggttatcttcttgttttttatgagtattattttcgttttcctgggcgtcatcggcgaatacatccgagtgctgctacaggaggtaaagggtcgtccctttgccgttgtcgatacgacggtgggcgatgtcgccaggccggaagcgccggtcagaatcaagcgaagggagtaagcggccgcaatgcgaaacattgtccatctgtccgaggcgttgcccgtcaatatgaccgattattggcatgacatcgccagcctggagcatttctgggtacgtcgtcgcctggaggtctttcgcgccctggccggccaaacggcccgggacatgggaccggcggccgacatcggctgcggccgtgggcttttgcaaagccagttggaacgggaatacggtctggccgtggacggctttgatctcgacgaaaacgccttggcccacaacctgagcacgtcaagcggcctatacgtctacaatatccacgaccgtttgcccgagctggcggggaagtacaaaacgatcttcctgtttgacgtgctggagcatgttgcggatgaactgggctttttagagtccgccttgcatcatctgcggcccggcggcctgctctacgtcaacctgccggcttaccagcatctcttttccgcctacgacaccatggccggccatttgcggcgctataccctggcccaggccgaggatcttggccgcagggccggcctgcggctggtcaggtcaacctattggggcgcgccgtattatccgctgctggtcgtgcgcaagtttctgctgcggctcaaaaaaacggaaagcgacattgtcgccacggggtttgacgccaaaagcgataggctcaacacggcccttggctacctcggtcggctggagccgctgccccaacgcctgtttggcacctccgtcatgctggcctggcaaaagacgcggtaacgtctccctggccggttggattgcgccgcccaggagtggccggtttggcgacgcaaagaccgccgtgtcgtggcggcgggtggtgatgagacttggctgcgtgttttcgccgcgagcccggacctcttgcgccgcttgaacgtcgtggcgcccgacaacgtgcaactcgtgtgtcttcggccggcgccccgaccttttccgcaacctgcccagtggctgcccggacccgtggggcgtcggtccgtgcccgcttctcggcgttataacgccgggtcgcagaccgtttccagacactgcgcggccatgggcaggcgcacatgaaaggcgctgccttcgccgaggcgcgactcggcccagatgcggccgccgtaatggcgcacgatctggcggcagatggccagacccaggcctgtgcctttgatggtcgggctgacgatggtgtcaccgcgccccacctgatggaaccggtcgaaaatggattcgagctgatcggccggaatgcccacgccctggtcgcgcacagtcatgagtacagcctcggcttcggcccgcacctccaggacgacctcgccccgttcggtgaatttgacggcgttttgcaacaggttggcgatgacctgcacgagttggtcagggtccatgaggagcggcggggccgaggtgtgggcgaggaaacggaagcggatttccgggcgctgggccagcagcccttcaatggactgcacggcctggtgcagcaccgccacaggatcgatgcactgatcgcgccactgcatattgccggattcgatgcggttgaggtcaaggacgtcgttaatcaggcgcgtgaggcgttcggcctcgccgtagaccacgccgagattgtgggcgatgcgcttgccccgggcggccaacgcggggttgtctccggccaacgggctgaaatgctcgccaaattcccgaccgatgagcttggcaaagcccaggatcgaagtcagcggcgtgcgcagttcatgggagacggtggagagaaaggccgatttgagtcggtcgagttcactcaagcggatgttggcctcggccaattccatggcctgttcgcgcagttcccgggtgcgttcttccacctcctcttccaggcgctgtcgatgggctcgcagttccgcctcaacggccttgaccgcgctcaaatccgagaacatcccgagggatccggcgaagtttccgtgttcgtcctgcaaggggctggcggagatgagcacccagagcatcgtgccgtcgcggcgctcgatgcactgctcgaacacgtcgctgaagccgtcccggcgacgttgctgttgccgggcggcccgctgctggctttccggcggcaggaactcggtcagattgcggcccaacagctcgtgggacgcataccccagcatgtcggccatgcgtttgttgacgaaggtggtgtcgtagttcacgtcgtagacccacaccccctcgtgggcggtttccacgatgccccggaacatggcctcgctctggcgcaacgccgcttcgcgccgctcccggtcggtgacgtcgcggatggcttcgatggccccgttgacttggccggactcgtcgtagagggctacggccttggcccagacatggcgcaggccaccgggcatggcggtcagggtgacctcggcgatgatttcgccaggagccatgtcggcgacctgatagcgcgggtcgggcattgaaacggccccccgggcatagtccagaagcagcggggtgggctggccgtaaaatgccgcgccgtaggcaaaatcacccttgccgagcatgtcggcggcggcgatgccggtcaagcgctccaaggccttgttccagaaggtgacccggccgtcccggtccacggcaaaggcggggtctggcagaaactcgatgatttccgagaagctgcgatcccgggccttgatgctggcctgagcttggcgcagttcgtcaatgcgccaggcctgctcgaaattggccacggccagggtcgagaggtggttggcgaagtggtgcagggcctggcagattttttcaaaccgggccaggggcatacgcggcacctcggccagggcggcccggaaggccgcctcatcggccccaatttcgcgggcataggcggccatggcttcgaggtcggcctcttcgtccaggacctggcctaccagccagttggcgatgtggcgttcgccaacatggatggccgtgccgccgtcgaggaggccgccgctcaggcagcgtcgcaccatggggccgccaggcgtcccctggcccaggcagacgtcggaccggatgcagttggcaaggcccttgggcgtgccacgaataactttggcgcacagggtggtgaaattgctcggccgggtcagcggtcggccttggggatcggttatcagcgaggccacgcccgaagcagcggcaaaagcgtcctggatgcgctggatttcctcaatgtggaatagatcctcgaaacgaagccgggtcgaatccacggacaaagcgcccccatggcgcggttggccgcaagcgtcctgtgtttccggggcgtcacatacggagggctgatcctgggacatggcgactcgcttcgtttctgaaccacaaaagcgtgacaacaataccgcatacgatgggtttaatacaatggctaatttctctcgacaacgcggcgttcctgtcctgtcggagaggcttgggcgggagtttcgggaggcctgcagcgaccacggaaggcgggaaaccgcgttgtctgcctccgtttgccagggggcatgtcctggctgacaaaaggccccgaccggagcacttccggtcggggcctcttggcggcgcggggctcaagcgtcgtcaggcggcgtgcaccaggcgttgcatggccttggccagggccggctccagggggacgctgggcgtcggcgcgcccggcgcgtcctcgtacattttccaatagtcctcaaatgcctggtcgatggtgcgcttttcggcgtagtcccggccggcccggcccatggcccgcatgagttcgggatcggcgatcaagccggccatggccgcatagagcgcctcggcgtcgccggccggaaccaccacgccggtttcgccgggcacgatgttttccatggggccgccctggttggtgacgatgatcggcaggcccgaggcctgggcttccaggaccacgttgccgaaagtgtcggtggcgctgggaaagacgaacaggtcgcaggcggcgaaaagcccggctagctcctcgccctcacggtagccggtgaagaccgtgggcgtgctggcaagctgcgcgcgcagttcgtcgagataggggccgtcgcccacgatacacagcgtggcctcggggtgctggcccacgaggcggcggaaggccgcggccagcagatgcaggtccttttcccgggacacccggccggcgtagagcaggcgcgggccgtggcccaggccaaaacgcgccgcgagatcctcgtcgcgcttggccggatcgaagcggaccacgtccacgccgcgcgggaaaagccgcagcttggccgggtccagccccttttcggccagctcccggccggtttccctggagggcacgtacaccaggtccatctgattgtaataccagatgatgcacttccaggtgaggtcttccatggcctcgtcgccggtgagaatctgggcgtattggggcagggccgtgtggtaggtgccgtagatgggcaggcgcagcgtcttggcgatgcacagggcggccaggccgatggggccgggggtggccgagtggatgcgggtgaagttgccggcgtagacggagtggagcatctccagcaggggcgggtagtagagcttctggtcggggtactcggccaggctgtagacgccgatgggcgtgaactgctgcacgcccggctcgaaaacgcgcgggccgtggtcgcaggtgtagatgcttaaggattttccggttttgatggccagctcggcctgctggcgcagggtgccggacacgccgtttatttcgtggaaggtgtcggtgaagtgggccacgcgcacggcggcgtccttgccgttttgtccggtgagcgccagcctggcctggctgctgaactggcggtccttggtgaagatggagtaggccaggaagtatggggcgagcatggtgtagagcgccccggccgagcccagggccccgaagatgtcgaagacgttggctccgctgacgtgatcgagcagcgagccggcgaaatgggcggccacccggttggtggcccggttgacgaaggagaaccagccgttttccaggctgtcgttgccaaggacgccggccctggcgaattccatgagcgccgggtcggagtggataagcgattccgtctcggagcggatcagttcccgaagcggggtgctggcgctcttgcggcggcgggtcagtccccgggccagccggcttttgaggcgaaaggccaaccccacggcctcctgttcgccaggttccaggaaccggtccacgaccttgagggtcacgtccttgtccaggaaccgatcgataccgaagcggtgtttataatactggtaggcgatgctgtagaggttgcgggccatggtgcgcggcgtgctcgacgctccccgggcgacagaggccccgttttccaggccgtcgaggaattcggccaggttttcggcgccctccacctcggtgtaggtggaggcgatggtgagcgcactgtggtcgtcggaaccgccgatcaggttcttgcgccatggctgggcatagccggggtcgatgccgtgcttgtcggccagccgccagatggtgtcggcgtcgaggttagggatgatgtcgcgcaggcagtcgttttgccaggcgtcgcgcgcgccgttgatctcgaaattgcggaacagcagcaggagcttttcaaaattggccacggtcatgcggtcgttgaccccgaaaagcgggtgggccacggcgtggtggatgccttcctggcgcaggtaatcgaccagctcgtggatgttttcgcgcaggcgctgcatctcccggtgcatggcctcggtgatgtcaaagaccagcacatggaccttgcagcggtcgtcggggaaataggacgtcacttcctcgctgacgaaggttccgggcagatgggcgatggatagcaccccttcgatgcggttgtgatcggagatggttacaagccccatgcccttgcgccgggcttcctcgtagatacgcatcggttcggtgaagctctcgggacagttgagcttttgcagcacccactgggacgggcgggtggagaatttggagtgcacgtgcaggtcgattttcatgacggctccttggggcacggggcaacgccggctcgcgtcgccgtttgcggcttgtagcgccgcccgcgtggcggtcggattgcggttggccgcagttttgttgacgtcggccgggctattgtcacggaaatgtcgcttgtcgcggccgtctgcctgtcccatggtgcatccatggaaccacggcgggaaccgtctggaataggcgaagccgaacggcgcgatttcgtgcgccagggccgtgaggtgctgttgtccctggggcagcgggatctggcccgtcgctacggtctgctcgcggccggggcctcctcgcgggaggaactggcggaattgctcctgtcgatgcttcagtcccgccacgccggataggcggtcctcgcctgtcccggccccggctcaggggagtccccatggaatggaacaatgaccatccgccctacgtcaaaggggcgttgcgctcccgtccgggacctttggggtccggtccggacgacgggccgggcctgtgcgacggccttttggccgctgacggggaaatgggcctggtgacggcggccatcgccgatttcgccagccttctgcccgagattgatctggaaaccggttgcgagattttgcgcctgttggccgagggtgtgcgggaaggctttgcccgccattttccaggctgccgggcgctgcggtttcaggaaaccggggtcgcctcccagacctgtgtttttgcccaggggccaggctgccgcgagcccggcgcggttctcgggttcttcgccgccttccgggccgccctggccgggccgttgtccgagcgtctcacgcgcctggccggccgccggttggtcgtggaggtcggctacgcccgcctggacgccgccgccggagccgggccgcgccagctgttgcgggccttgtgccaggcccagtgcctgggcaagcacggctttgacgacgaacggcgccgtctgcaccaggcctttgagcgcctcattgccgcccgggaatgcgacgtgcgctaccagcccctggtcgatctggccggcggcggggtgctgggctgggaagcctcgcttcggggcgaagccgacggccctttcgccgccgtcggccagctctgggcctttgccgccacctgcggcgaggaagcggggctggaccggcttttccgggaactggccctgtcccgcctggggctgcttggcgaccgtcaaaagctctttttgcccatccgccatgccagcctcgacgatccggcttttgccgcgcccaggctcgccgccgatttggagcgcctgggcctgtccccggccgacgtggtgctgtgcgtttccgagaaaaacgtcctgggcgacctgtcctgcctgtttgaacgcctggaaccccaccgggccgccgggtttgccctggccgccgacgacgtgggcggcggggcgtccaacctgctgctgctttcccgggcccggcccgactggatcaagacctgtccgggcctggccgaggccgtggaagccaatccctttaagcgggtgatgctcgaaaccctggcgcttttgtcggaaaaaatcggcgcgcgtctggccgtggccggcatcgcctcggaactggccctgtccacggtggcctccatgggcgttcatgccgccctggggccgcatttcggccagccggcctgtcccaagctggagcaggtggccgaattgccgcccaaggcgaacttcgacatcctgggcggcggcggctggcaatcctcggcccccattggcaatctggccgaggcctgcctcaccgtggccgaggacactaccgtggacgaggtgcgcgggctcttggccgaccggccgcccatgaccaacgtggtggtggccgccgccggccggccggtgggcattctcatgaactaccatctggatcgccggctcagctcccgttacggcaattccctttttggccacaaatccgtcacccgcatcatgaaccccaagccccttgtcgccgaggccgcccaggccgtggaagccgtggcccggcaggccatgaaccgcgacccggccatggtctatgacgatatcgtggtggtggacgggaccgggcttttagtcggcacggtctcggtgcaaaagatgctcgactccctggcccaggtgcaggtggagctggccaaggggcttaatcccttgtccggcctgcccggcaacatggccatcgaactggaagtggggcgtcgggccaagctcggcgggccggccagctgcgtctacgtcgatctcgacaatttcaaggtctacaacgacgcttacggtttttccaacggcgacaaggtgattctgctcacggccagggtgctggccgaagctctgcgcggccggccggactgttttctgggccacgtggggggcgacgatttcgtgtgcatcaccccgcgagaagaggccgaaggcctgtgccagcgggccatcgaggcctttgccggggccatcggcgaccactacagccccgaagaccgccgacgcggagccatcgccggcaagtcccgcgacggcgcgcccgggatgttccccctggtgtcgctgtccatgggcatcgtggactgcgctttcgagatacctttcagcgccgaggagttcagccagcgggtggcggaagtcaagaaattcgccaagacccgggccggcaactcctacgtgcgcgaccgccgcgctccccttggcgcgcgggtttgaaccgtttcgtcacgcaggcggcctttgtcaccggtttgccataaagccatggcctgttcgtcatgggcggcgggcataccggatcaggccgggcgcgatgccgccccggccggcacaaacgcccaaggacggctcgccccatgcaacacagcgtcaaaatggccgcggtggacctcgacttctactacggtcggttcaaggctcttgagagcatcaatctggaaatccccgagcgccgggtcacagcgctcattggcccgtccggctgcggcaaatcgacctttttgcggtgcctcaatcgcatgaacgacctcatcgccggcacgcgcaccgaaggcgcggtgctcctcgacggggtcaaggtcaatgtgcccagcctcgacgtggtggagctgcggcgcaaggtgggcatggtctttcaaaagcccaaccccttccccaagaccattttcgagaatgtggcttatggccttcgcgtcggcggcgtgaccgatcgcaactacatttcgagccaggtggaaaagagcctggtcgcggccgggcttttcaccgaagtcaaggaccggcttcatgattcggccctgggcctttccggcggccagcagcagcggttgtgcattgcccgggccgtggccctggagccggaagtgctgctcatggacgagccggcctcggccttggaccccattgccacccagaagatcgaggagctcattgccgagctcaagcgcaactacaccatcgccatcgtcacccacagcatgcagcaggcggctcgggtctcggacctcaccgcctttttctacatgggcaagctcgtggaagtcggccctaccgaagccattttcacccgtccggccaatcagcagaccgaagactacgtgaccggccgtttcggctgatgccgcaggcgcgccataggtcgccccgccagaaacaacgccaagccttcgggagccatttcatggaaagcagagcccattttcacgccgaactcgatgccctcaagggccgtgtcatcgccctttccgtgctggtcgaaacggcccgccagggcgcggtggccgcctatcgccaaaacgaccagaccttggcccgccagatcatcgaaggcgacaaggccatcaaccagcaggcctgcgacatcgacgaggcctgcctcaagctgttggccctggagcagccggtcgccctggacttgcgccgcatcgtcggctacgcccgggccgtcatcaacctcgaacgcctgggcgatgaagccgtcaacatcgccgagggcgcgttggtcggggccgggcttccgggcgactgcgacggcgcgctcatggagctttccgaccatgtggccggcatgttggccctggcctcgcggtcctttgtcgaggatgacgtggacgcggccatggacgtctgccgtctggacgagcgggccagggaactggccgtggccgccatgcgctgcatcaccgaggcgctttcgcgctgccaggccgcgcccgaggacggggtgcgggccattctcgcctgccgcagtttcgagcgtatggccggacacgccgccaacctcggcgagatcctggtctttatcgtcaagggcgtcatcctgagccagaaatgccagccccgctagtctcggcccgtcctttggagcctttgcccatgacggccgcctgcgccgacgtcatcgccgccagccgcgctaccgtgccccatgtcgtggacgtcatgccgggcggaacgcggcttcgcgtacagaccaacagtttgcccctggcccaagccctgagccgccatttcgccgcctttccgggcgacggcggccagcccgatctggttgtcaaggccgtggacggccccagcccagagcttgacctgacctttgtcccccacgagtccgagggcggcaaggaagagtatgccgatctgcccgacggccgcctggtgcgcaagcgccgtaccgggctgctgctcgtcttcggtgcggccggcaactggattttcggcccctgtgccgcctggccccagcaagtgatcaacgccgtcaacgcccggctggccgatcgggaactggcccggggcgcggcgctgctccatgccgccgccgtggctcggggagaggccgccctggccctggccgggctggccggcgcgggcaagaccaccctggctttggaactggtgcggcgcggcgcggatttcgtcaccaacgaccgcttgttcgttacctccgaacccaacggcttcgggtgttgcggcgtagcccggccgccccgggtcaaccccggaacgatcctgggcaacgaccgcctgcatgggcttcttgacccggccgagcgggccgcttatgccgccttgccgcctgatgcgctatgggggcttgaatccaaacatgacgcccccattgagacgtgtttcgggccggggcgggtgcgccttcgggccgggcttcacgccctgatcgtgctgtgctggaaacgcggcggcggccccgtggacgcgcgctggaccacgttggcagccgcgcccgaactggtcccggccatcaccaaggacctaggcgtgctgtttctggccggtccgcgcccggccgatccggccgcctatctcgccgccctgggagaactgccggtgctggcgctcttaggcggcacggacgtttcccacgcggcccagttgtgccaggacatcctctggcgcgccgacgaaggtcggccatgacgacattgcctgtaccgagcctcgacgctattgaaggaaccgacgtgccagacgccaagccatcgccccgggcgcgcatcgcccgcaccgtgcgcctgcccgatccgtcccgggcggcgcttttccgccgcgctccggaactgggaccgcgcgtgctctttttcagcggcggcacggcgcttcgcgacctcagtaccacgctgattgaatacaccgccaattccatccacttgatcacgccctttgattccggcggttcctcggccgtgctgcgcaaggccttcgggatgccggccgtgggcgatctgcgaaaccgcatcatggccctggccgaccgcagcatcaccggcaatccggccgtgttcgagctttttgcccaccgcctgcccaaggacgcgccccaggacgaactggcggctaagctcgtacggatcatgaacggcgaagacccgctcatccgccgggtgcccgatcccctgcgcaagatcatccgcacccatctgcgctttttcaacgaacgccgtcccaaggatttcgacctgcgcggggccagcatcggcaactgcatcctggccggcggctatttcaactacaaccggatgctcgacccggtcatctacctctttatgcagctggtcgaggcccggggcgtggtgcggcccatcgtcaacgccgacctgcacctggcctgccgcctggccgacggtcgggtgctcattggtcagcacaacatgaccggcaaggaagccgcgcccatcgacgcgcccatcgagtccctgtggctgaccgccagcctcgacgacccgaccccggccagcgtgcgcatccgcgacaagaccgacaagctcatccgtcaggccgaggtcatctgctttccctacggcagcttctattcgagcctcatggccaacctgctcccccagggcgtgggcgacgccgtggccgccgccgattgtcccaaggtctacatccccaatctcgggcacgatcccgaacagcagggcctgaccgtggccgaccagacgcgccggctcctggacgccctggaagccggctgcgccaaggcctgccgccgcgaggacctgctgcgcttcgtcttcgtggacagccggggagggcgctacgacggcggcctggacatcccggccatccgccgcctgggcgtggaagtggtggacgtgccgctggcccggtccgacgattccggccaggccgacagccgcaaggtggccgagctgctcgtttccctggcctgatcccaaagcttccgcagtgtggcggagcgcattcccatggacgatgccgcccctgtccctgtttcttgattccaaggagtccgcatcatgatgcagtgtttcatcggcgaggccggcaagccgcagatcgtcgacagcgtgacgcggaaatgctggattcacatggtcgatccgagcgaggacgagatccagtacatcgtccgggaactcggcgtgccgctggatttcctgaccgatcccctggacgtggacgaacggtcgcgcattgagcaggaggacggcgtgctgctgctggtgctgcgcgtgccggtgcgccacgacgagacctcgggcggcgtgcccttcgccaccgttgcccagggcgtcatcgtcgccggggatcatgtggtgacggtgtccaaggtggaaaacgagctgacgcgccatttcgtcgatggcctggccaagcagtgcaccccggagcggcccggccggttcgtcattcagctcttgcagcgaaacgcgctgcagttcctggccgatctgcgggagatcaaccgcctgaccaatctcatcgagcaggagttgcacaagtcctcgcgaaacgaggagctcattggcctcgtcaacatcgaaaaaagcctcgtctacttcatcacctcgctgcaatccaacaacctcattatgaagacgctcttgcgacgaaaaatcatcgccctggacgaggacgagcgggacctgctcgaagacgcgctcattgaaaacaagcaggccatcagcatgaccaagatctacaccgatattttaagcggcctcatggacgcttttgcttccatcgtttccaataatttgaacgtcaccatgaagtttttgacctgcttcaccatcattctcatgatccccaacatcctggccggcctgtttggcatgaacgtcaagctgccgctgcaggacgaacctcaggcctttgtctacatcgtcctggcctcgttggcctttgcttttgctctgagcgcggttttcgtcaagaaacgctggttctgacgcgcccctttaccggacgaaacacggccccggttcgcggcagcgaaccggggccgtgttattgtgaacagactgcggctgcttcggccttgatcgacggcttcttgccttctgcgccgagcagagcgtcaatctgcgcccgtccccttgaacccccttctttcattgcaggggtccggggggatcatccccccggccgccggaggcatttcttccctcccgctacccggacatggcctgaacgcgcacgaattcgccaagcgccttgtcttcctgggtgatgtggctgatgaaccactccttgagaaagaccaggatgtcggccagcatttgttcgctgaccacgccgaattccttttcgatctcgaaaaagatgacatggttggcgaagagttcatgctgctggcggtgggcgtcgagttcggggtagccaagatcaagcatgagttcggtttcgaggtcgaagtggtcgtggagataggcgcgcaaaaaggccagggccttggcggcgtcggcttcctcggcctgtccctgtctggcggccagatcattgatgaggcggatgatggcttggtgctgttcgtcgatttccgtcacgcccacggccaaagattcgtcccatgcgatcatgtgttttctccaaagcctggggccaatggggcgcggccggccccggtctgacccggacggggtgatgtgaatcagggtacggcaaaaaaccccgattctttcagctttgcgcccgttgcgtgcggggcttttgcgggggattgcgccaacatattcaactgtctatgcaccatgccatagccagggaacatgtcaagacgacgcgaatcaccagaacgtggattcgcccaacgacattttccgaaatgcttcccataaagccttacggtgagttagactcagcgtgtcatgccgttttgacctcttacttggagatggccatggttcgctcgtttaggcttttgctgctcggtctcctgttgctcgtttgtctgcctgcctgccgcacggccggccccacaaccccggcggccgccgggcgcagcggccaagctgcgaccatccaggcaggtaaatcgcccctggacggctcccgccaactcgtgctggtggtgaccgaaagctttgacgacaatcaagcccgtatgcgccgcttcgaacgctcggggcctggctcttggcggccggtgggcgacgacgtggccgttactctcggcaaaaacggcctggcctggggccggggggtgcacgggcaaacgcctcttgggccgggaccggtcaaggtggagggcgacggccgttcgccggccggtgtgtttgcctttggtacggccttcgcctaccgccccgaagacctgtggcagccggccaagatgcccatgcaccgggtcaccgaccagacggtgtgcgtggagagcataagttcccgctggtacaatcgtattgtggacgaaaacaccgtcccggccgtggattggtcctcgcccgaccggatgctgcgccccgacggcctgtaccgctacggcctcatggtggaccacaatgcgccggacaccaagcccggagccggttcgtgcattttcttccatctgtggcggcggcccggcgcgccgacggtcggctgcacggccatgaacgaagcggccatgctggccgtgctggcctggctggacgcctccaaaaaacccattgtcgtgcaactgccccggaccgaactggaacgcctggccccgagctggggcgcgtccgaactcgtcgtcctgcgtcttacgcccagggaatagcctggaaacaaaaagaaaattgctccggcagccgaggggatgatccccccggccccctgcaattggaacaatgcttcaaaggggggcggcgtggatgcgctctctgccggctgggaaggtaaagtagtcgaggttggcgctcaaggccggcggccgagaggctaaggccaccgacaccaaaacggcaacgggggaagatgggttgtgcagcctgggaaaagcggctgcagccgaggcggtgctcccacctcagccaatggctccagttagcgccccgaccaaggtcgtcgctttggtgtgaaaagacggcgcgccgtttgacggtgcgccgtcttgtcgttttgcaagccaaaggagggtggccgggcagatgcccaggctcgccggttcaggcggtttcgggctccttgccttgcttcttgagggcatagttgaggagttttctggcctcgacgaattccggcgacaggcgcagggccagacgtgacgatttttcggccttgtcccagcgttcccagtcgacatagagccggcccaggttgaaatagaggttggggtcggacttggcgaactccgccgcccgcatgaaatagcgttcagcgatgtcgtacttgcgtagcttgcgaaggacaatggcgatgcggttgtagtgatggatctggtcgggcgaaagctcgatggcttcgtcgaggtaggaaaacgcttcttcgtagagttcgccgccgatgaaaagctcagcgatgcgggcgcgcagatcggcgtcatggggatgttcccgggcgagcttttccagcagcgccttggcctcgtcgatgcgcttttcctcgataaggagcttgccttgggccagaccctcggcaatgcgctgttccttgtcggcgataatgtccttggccgcttccacagccgtggcttgcagttcgccaaggacattgaagagctggtctgccagctctttttccgcgccgggcttgtaatcgaggatgaggggatagatggtgcgcagattcctgtcgccgttaaggtgcaggaccgcgtcggtgataagcttggaaaactcttctttttccgaacggataagcggcgttcgcatgaccgccgcgatggcttcgtacaaggccgagacggccggcaggggcttggcctgcttgaggaacgtcccgaccttgttgatctgggcccgagctttggtcagttcacctgacatgctaccccggcgctgtggcgcccgtgcttatttgcccgtttccttgcgcaccagattgcggaagcggctgaagaaataccggctgtcatggggacccggcgccgcctcagggtggtactgaatggcgatgacgggtttcttcttgtgggcaaagccctcaagggtgttgtcgtttaaattgacgtgagtcaactctacgtcggacaggctctcgatgtccacgcaaaaaccgtggttttgcgaggatatctcgatacggccggtctggagatccttgaccggatggttaagcccgtggtggccaaacttgagcttgaaggtgcgcccgccaagggccagacccaggagctgatggcccaggcagatgccggccagggggtattcgttgaccagaagcgacgtggtatggaccagatcggtcagggccgccgggtcgcccgggccgggggagagaaagaccgcgtcggggccgagcttgcgcacctgttcggccgtggtggtgtagggcaccaccagcatgtcgaagccctgggcggtcagaagccgcaggatgttccacttgatgcccatgtcgaagaccaccagcctggggccggttccgggccaggcgtaggtcccgtccacgatcttggccggctccatggccgtgccggaccaggtgaacggcgcgtcgcagcagacccggtcggccaggcccaggccttccatggacggcaggcccttggccagcccgaccacgcgttggggatcggacacgtcggtggaaatgtagccccgcatggctccatgcaggcgcaggtgacgggtcagcgcccgggtgtcgatgccttcgatgcccgtgataccctggctggtcaggtattcgggcagggtcatggtggagcgccagttggagggctccttgcagcattccttgacgatgaagccggccacgcggatgtgggccgattcgatgtcctcggggttgatgccgtagttgccgacgtggggataggtcatgcacaccatctgcccggtgtaggacggatcggtgaggacttcctggtagccggtcatgccggtgttgaagatgacttcgccgccggcgctgccctcgccggtaaaagtgtggccgtggaaaagggtgccgtcttcgagggccaaaatggctttcatgcgtgtctccggacgtgttcgctaaggaccgcaacttgcggccggcggcagggtatatcggaaaggggccggcgtaaagggccgggcatccccgggtgcagcgctcacttaaggcctcttggcttgctgcgcaaggccaagttcgatcaggcgcgcgataagatcggcgaagctcaggcccgccgttgccgccgcgcgcggcaaaaggctcgtcggcgtcatgccgggcagggtgttgacctccaggagcctcaggccctccggggccaggatgaaatccgcccggctgtagccgcaaagcccgagaacccggtgggcggccagactcaggcgcgaaagttcttcggtcacggctggttccactggggccgggcagatctcgtcggccgcgtccggctcgtacttgctggcgtaatcaaaaaactccccggccttgggccggatgagtatgggcggcaaggcttcgtcgcccaggacggcgcaggtgagttccggaccggaaagcccttcctcaatcagcgcgtcgtcgccgtgggcaaagactttttccagggcggccggcagctcctcggcccggcgcaccagggtcatgtggatactcgatccgccgaggttgggcttgacgaaccagggcagggggaaatccgggcgcgcgctcgtgccggcgtcgcggggcacgaacgtccagcgcggcgtgggcaggcaggcctcgaggaaaagctgcttggaggcggccttgttcagcgcaagaaacgaaccggccgggccgctgccctgatagggcacgccggcggcgtccagaagcgcctggggcagtccgtcctcgcccggcgcgccgtggaggctgagaaacacgaagtcgcaggccttggcccgtcgcacaaagccggggaaatcgtgggagaggtcatagggcacgacctcgtggccaagggacgtcagggctttttcgatctggaccgcgccggagagcgaaacggcccgctcactcgaccagccgcccgcaaccaaaagtattttcatggatgtctatgccaagcgttgcggccagggcccgttcaatggcttcggcctgttggaaggattcgcggatgcggccccggatgtactcggtggttccgtagcgcaccagcagatcctcaaagcgcgcttccagggtcacgatctggttgtgcttgacccgtttgtcgctataaatgagggccagcggcaagaaatcgacggcgagatcaatctcgcgcggccagtggacatggcacagcaccccctgggccagggccggattgccggtgatctcctgcacccaggccgccccgagctggcagtggttgccgccgtggcggatggtgtaggtcttggccagatcgtggagcagagcggccgcccgcaccgcggtcacgtccacggccaatcccgccgcccgggccagttcggccagggccgtggccagacaggccaccagttcgctgtgggctcggatgttgggcaacatgccgtaggcgtcccacagcaagcggcactgggcgtcggtggggacggcatcgaccggcggcaactcggccacgagcggcagggccacggcttcggtcgggggaaaatccgcctcgggagcggcaaaaagaggcttgctggtgctgtcggacatggaaatgcagccggaagcgggcgaaaaaaaacggttcgctcccggcctcggttctgataccaaccctgcttaaaaaagcaaaggccgacgtgaggcatacgcgccggcagggaaccataatgaagaaattccgcatccgctacgagacgaggcttctctacggcctggaagggaccgagaccgtggccgcctcgagcaaaggccaggccatgctggccgtccaggccatggtccacccggacgaacgtctcgacgagccctatttccacttcgagcccctgaccattcgtcagatcgagcccggccggtacgaagtggcctttcgcaccaaggtggaaaaacccgtgtccggcgaagtggacgtggaagcaaccgacgccgacaaggccgtgtccaaggcccggctggccgtgcaccaggaattcattccgcccaaatgcttcagggccgtggccgtggaggagatcggcggcgcctagtccgccggccttttgacaagcgccgcgcccatgcgcatatctttcggacgcgctggccaatccgcctgccgccaaccgccagacccggaggtcctcatgtgccttgccgttcccatggaaatcaccgccatccatgacaagatcgccgacgtggaaatcggcggcgtcacccgccaggtgcgcctggaactcatcgacgcggccccggctgtcggcgactacgtcatcgtccacgctggcttcgccatccgtcgcctggaccgggaagacgccatcgagaccatcaagcttttccaggaaggactcaaccttgaactcctttgaggccttcaaggacccggccctgtgccgggcgctgctggagcgtttgcagaaagaagccgacaccccctaccggttcatggaagtctgcggcacccataccgtttccatcttccagtccgggctgcgtagcctgctgccccagaccatcacccacgtgaccggcccgggctgcccggtctgcgtcacccacgaatccgaagtggcttgtttcctggacttggccacccgcgacgacatcgtgctggccaccttcggcgacctcatgcgcgtgcccggccccaagggcaaaaacctcaagacggcccaggccgacggcgcgcgggtcgaggtggtctattcgcccgtggacgccctggccgtggccgccgccaaccccgggcgcaccacgatttttctcggcgtcggcttcgagaccaccgccccggccgtggccgccaccatccggctggcccgggagcagaatctcaaaaacttccgggtgctgagcttccacaagctggtgccgccggccctggccgctctggtcgccgacccggacatcaacatcgacgcgtttattctgcccggccacgtctcggccatcatcggcgcggccccttacggctttttagccgaaaagcacgggctgccggctgtggtcaccggttttgaacccctggacatcctgtcggcgctgctcgaaatcacggccatgcgcgcctccggccggccggccgtggtcaacgcctacacccgcgtggtggcccacgacggcaatcccgtggcccgggcggtcatggacgaggtgttcatccccgtcgatgccctgtggcgcggccttggcgttttgccgggcagcggcctggacattcgcgaggagttcgccgacttcgacgctctgcgcctgcccggagtcagcctgcccgacgtgccgcccttggccggctgccgctgcggcgaggtgctcaaaggcaagagggcccccaacgaatgcccgcttttcgacaaggcctgcaccccggccacgcccgtggggccatgcatggtctccaccgaaggcggctgcgccgcttaccacaaatatcggttggagttgtaagaggaagatgaagatgcctccggcggctgggggcttgaggcccccagaccccccatatggggaaaagggggtggagtattggcatcgatcacacacagggatggggcatggacaaggttttgcttgattacggcagcggcggccgggcttcgcaccggttcgtggccgatctgttcttcaaatatctcggcaacgacatcctggcccgcatggacgacgcggccgtgctgtccctcaccggcccggtggccatgagcaccgacagcttcgtggtggacccgatcttttttccgggcggcgacatcggttccctggccgtccacggcacggtcaacgacgtggccatgatgggcgcgcgtccgctgtatctgacctgcggcttcatcctggaagaaggtctgcccatggacgatctggcgaaaatcgtcgcttccatggggcaagccgcgcgcgacgccggggtgcgcatcgtggccggcgacaccaaggtggtgccccggggcgcggcggacaagatctttatcaacaccaccggcgtgggcgaaatcatggtcgatccggctcccagcggccaccgggcggccgtgggcgacgtggtcatcgtctcgggttccatgggcgaccacgggctggccatcctctccacccgcgaaggcctgtccttcgaggccccggtggtcagcgacagcgcctccctggccggcatcgtgggcaaactgctcgccgccgtgccgggcgtgcatgtgctgcgcgatcccacgcgcggcgggctggccaccacgctcaacgagatcgccggccagtccgacgtcggcatcgaactgacccaggccgacattccgatccatccggccgtggccggcggctgcgccgtgctgggccttgatccgctctatcttgccaacgagggcaaatttttgtgtattgtgcccgaggcaaaggcccaggccgccctggccacaatcacggccgatccgctgggggccggggccaaggtcatcggccgggtggtttccgaccatccgggcaaggtggccctggtcacgcccctgggcggcaagcggctgctggggatgctcgaaggcgagcagctgccgcgcatctgctagtaacgcgtttctgacggcacaaaacgaagcatttgttatgcaagcggcgtgatacgcggcgctgacaccatataaccgacgggagcgcggacatgagcgtgtgcgatgttgtggtgatgggggctttggggcgcatgggcgcgaccttcgtgcggttgatccaggccgaaccggccacgttccggctggtcggggctttggagcgggcgggctgcaccgccgggctggccaatttgcactgcgagatcggcgacgatctggccacggtgctggccaaatgcccgggcgcggtggtcatcgacttcacctccccggagaattccgtgcatgtggcccggaccgtggccgcttcgggcaacccgtgcgtcatcggcaccaccggcctttctgccgagcagaccgccgaactggccgaagcggccaagaaaacggcgctgttttttgcccccaacatgagcgtgggcctcaacgtccttttggccgtgctgcctgatctggtgcgcaagctcggcccggcctacaacatggaagtgatggaaatccaccacggcaaaaaggccgacgcccccagcggcacggccatcaagctcggtcagtgcctggccgaggcccggggcctggactacgacacggtcaagcgccacgcccgcgacggcatcatcggcccgcgcaccagcgacgagatcggcgtcgccgcccttcgtggcggcgacgtggtgggcgaccacaccgtctatttcttcggcccgggcgagcgcatcgaagtgacccaccgggtccatacccgcgacaccctggcccagggcgcgctgcgggccgccacctggattgtcaagcaaaagcccggcaagctctacaacatggccgacatgctggcctagcgggcggccgtttgttcaccctattcggggcaaggccgcgaagctgacgaccaagcccgcgttgttcctgcgggggcaaagcgggcttgttgtctatgcggggggtccgggggcctcaggcccccggcggagagggtaaggcagaggcagcgcctctcctggccgccggaggcagcgttgccgtttcatccgctgactgttgaatggtttacggcccaggtcggccggcccacggacatccagtccctggcctggccgcgcatcgccgctggcgagcatgtgttggccgtggcccctaccggctcgggcaagacgctcaccgcctttctggccgccctggacgccttggcctgcggccggtggccggtcggccagaccagcgtggtctatgtttcgccgctaaaagcccttggcggcgacatccgggccaacctggcccggccgctttcgggccttcgccaggccttcgccgccgccggccgggagtttccccgcatccgggccgaactgcgcaccggcgacaccccggccgatgcccggcggcgcatgttgcgccagccgccggaaatcctcatcaccacgccggaatccttgaatctcctgctcagttctaagggcggccgggggatgctcggggcggtgcggctggtcatcctggatgaagtccacgccgtggccggctccaaacggggggtgtttctcatggccgccgtggagcggctggcgcttttggccggcgaattccagcgggtggccctgtcggccacggtatcccccttggctgaggcggcccggttcgtgggcgggctggctcccggcccggacggcgtcctggctccccggcccgtggccgtggtggagagccgggcggccaaggtcatgaacgtgcgggtggagtacccggactggagtgagcgcgaaggctccagggattccttccttgccatcgtggccggacgcatccgccgccgtattgcggccaaccgcaccacgctgtgtttcgtcaacaaccgcaagctgtgcgaaaaactggcccggctgctcaacgccgaccgggaaacgccgctggcccacgcccaccatggttcgctgtccaaggagctgcgcctggccgtggaaactcgcctcaaggccggcgagctcaaggccgtggtggctacccattccctggagctgggcatcgacatcggttcggtggacgaggtcttgctcatcgagtgcccgcccacggtgagcgcggcggtgcagcgcattggccgctccgggcacggcgtgggcgaggtgagtcgggcggtgttcttgcccacttcggaaaaagatctgctggaagcggcggtcatggcccgagcggcggccggccgcgacatcgaacccctgcggctggtcgatgcgccgctggatgtcctggcccaggtgctggtagctatgctcggggtcgagacctggaacgtggacgcgcttttcgacgccgtgcgccgcatctacgcttaccgtgacctttcccgggccgctttcgatctgaccctgggcatgttggccgggcgctacgccgccacgcgcctgcgcgaactctccccccttgtcgccatcgacgccctggacggcacggccagcgcccgggccggggcgctcttgcggctgtacgcctcgggcggggtcatcgccgaccggggctattacgccctgcgccgccaggattcggccacgcgcctgggcgaactcgacgaggtgttcgtctgggaggcgcggctaggccaggtgttcgcctttggcgcgcagaactggcgcatcgagcgcatcaccgacgctgacgtgttcgtgtcgccggctccggtcggggccgtgccggctcctttttggctcggcgacccgcgtcagcgcgaccgccatttttccgggctggtggccgcctttttggaagaggccaacgcgcgactggacgatccaacctatgccgaagcgctggccacggagcattttctggaccaccaggccgcgcaagccctggtcggctacctgcgccgccaaaaagacgtcaccggtgcggccctgccccatgcccgccatctgcttatcgaggtgacggacaccggcccgggcggcgcgcccggcaatcaggtaatcctgcatgcgcccctgggattggtcgtcaccgcgccgctggggttggccctggaggcagccctggaagccaggctcggccacgccgtgccggtctatgccggcaacgactgcctggccgtcaccttgcccggcgaggtcgatccgctggaggtgttggctgccgtgccgtcacggcaggcggcggcgctgctgcgcgaccggctggaaggttccggcgcgttcggagctgcctttcgcgaggcggccggccgggcgctgctgctgccccgcgacggcttcggcaagcgccagcccctatggatcacccggctgcgggccaggaagctcctttccgccgtggccggctacggcgatttccccattgtcctcgaagcctggcggacttgcctggtcgatctcttcgatccccaggggctggccgggtttctggccgccgcccagtccggggccatggccgtgaccgtagtccgcacccggacccaaagcccctttgccgccgacatcgtctggcggcacgtcaccgaatacatgtacttgaccgacgccggcacggcggcgggccccaccggcgcgcggcccgatctggtggccgagctgacccgccggcccgaccggccggccgtgcccgaggccgtggcccaggctttcgaggcccgtcgccagcggttgtatccgggctacgcgccggtgagtgccgccgaactcctggaatacgtcaaggagcgggtcgtggtgcccggggacgaatggcaggccatgctcgccgccatggagcgcgaccatgggctggccccggctgccctggaagccgccctgacacccaagctggcccgcctcgccacgccgccccagccgggcatcgtcgccctggagcgggcagccgaggcggccgaggcggtttacggcgatgcggtccttgtccagcccttggtggccaaggccaagccgccgcgccgagccaaggcggcgtccgaggaccaaagcgctgtccgggaagggctcattgcccaatggctgagctattacgggccgcgatccctggacgatttggtgtcgcgtctgggcctggactcggcaatacttcaagcggtacttgaggatttgcaggcggccgggaacgtggtcagcggccgcctcgtgaccggccgggacgaagccttgtggtgcgacgcggccaatttcgagaccctgctgcgtctggcccgggcagcaaggcggccggcgctggccgccttgccgccggaaaagctgccgtatttcctggccgtctggcagggcgtggcccaaccggccaaggatgcggcggccctggccgagcgcctggagcgtctggcctgtctgcctcttgccgccgccgcctgggaggccgacgtcttgccggcccgcgccctgggctacgacccgaccctgctcgacgccgccctggaggactcgggcctgcgctggttcggcgcgggaaccaagaaggtgctttttgcccgccctgaagaccttgatctggccggttttgcccggcgcgcgcccgatgccgggctgtttcccgatccccgggcttcgtatgatttttcggcgctgctcgacatcaccggcttgccgcccaagaccctggccgagcggttgtggcaggcggcctggaagggcgaggcgtcctgcccggccttgtccgtgttgcgccggggcgtggccaacgacttcacggccgaggacgcctatgcgccgattcgctccggctcgtcccacggcggcccggttcggcgcggtttccgccgcacgccgcccgggcgtttcgccggttcgctgccgctgtccggctcctggcaagcgcttgtcccgccgctgttgccggatgatcccctggccgtcgaggaactggccatggaccgggccagattgttgctcgcccgctacggcgtggtctgccgcgacatgctggcccgggagtccgccgccttgagctggaccgccgtctttcgggcgctgcggcgcatggagctgaccggcgaggtcgtgtccggcgaattttttaccggcctgtccggcccccagttcgccgatcccggagccgtgcgcttgcttgtcgccggccttgtcggtgacgccccctggtggattgccggcaacgatccggccgccgtctgggggttcggccaggacccggccgctcttgccctgccgcgacgcacggcgggggcttttgtcgcctttgccggcccgcgacccgtggccgtcattgaagccggcggcgcgcgcctgcgtctggcccttgccccggatgatcccggactgccggcggcgttatcgcccctggtccatctcctgtgccgccgcgtttctcccctgccgcgcctgaccgtggcgaccataaacgacgtcccggccgacaaaagcccctacctcgcgatgttgcgcagcctcttcgaggttgtgggcgaacgccggggagtcactctgtatcggtcgcgttcgttgtagcgagggggacaggagaagacgggggaggcctccggcggctgggggcctgaggcccccagaccccccaaatgggaaagggggcgggcgttgctgccgcagggcgcgtcagaaacgcagccaggcgggcagcggcagcctgggacaggcggctgaggacggccggtaggtcgggaccggccaaggcggcggccaggggcggatggccggccaggcgcggagccaggctccagccgcccggcgcggcgggatcaaggcggatgtcctcatagaagatggcaaagccgccggcttcgtcggccaggacgccgtggagcagctccaacacggcgtaggcaaaatatttttccacatccgcgccgtgccggcttttggccaaggcggcggcaaaggtgggccaaagggcggtttccaggctttcaaaggcgttttgggcggacatggcggtgtctccgtggcgaaaaaccgttgggtacggcagcccggccccgggcgcaagtccccttgccatctggcaaagctttggccatgacggagatggtccgaaatccctcgccaaggagccgtccgccatgcccgagtccagcctgcccgacgccgccgtcctcgcccgaagcgtcaaccgcgacctacgccgccaggtgagcgaactggctccctggttcgcggccaacatgccggcctactatttccgcacccacgacgccgccgaacaggcccgccacctgcgcgccgtcatctccggcgaagtgctgaccggcggccaatcggctaccctctgggacgccacccgcacccggctgacccgcatcgccccggccaacggttcctgcctgctcgaccatctggccgaacgggttgacgacaatattcgcacctcgcggctctacgcctccctggacggccgtttgcggctggacacctttctgctcgacccccagccgccggtggcccccaaaagcccggccatgcgtcgggccgtggccgccatgatggccggcggccatctcgatgcccggttccgccaggctttcaccgcctttctcggcggcgcaccggcggattacgtcgagaagttcgaccccctgcgggccgcccgccacttcgccctggcccgggaactcgacggccgcgacggcgtgcgggtggagctgcatcttttggccgacgcttccgagagccggcttgtcctggccatgcgtgagccgccccggtccggacttttgctgcaagtggcccaggccgtcatgtccgagggcctgtccatcctgcgcggctattccgaccggtttgtcctggccggcggagacctgtcggttattagcctctacgtcgcccggggaggccgggcccttgacccggccgacgcggcctggaaacggctgcggctgcttctgcgccgggtcaagtggagcgtgccggcccaggatcagcccctggccgtcctggcttcgcggcacgggtttgcccaggaggaagtcgagttgctcggggccggctgcgaatgcgctcggcaattcctgctgccccgaaaccgctacgccttttccatggacaacgtgcacggcgtccttatcgcccatccggcccgggccagggcgctgctggatgtgtttgccgcccggtttgatccgcaactgcccgtgcggcatcgggaaaccgacgatgggccgctggccggagccgtgctggacggcctcgacgacgatctggcccggcaggtgtttgccgccgtcatcgaactgtggcggcatgtgctgcgcacgaactgttatctggccgaccgtttcggcctggcgttccgtctcgaccccggcgtcatcgaggcaattggcggcgtgcctcgaccgtccggggagcacctgccccatgcgctctttttcgttgccggcccaaaaatgcgcggcttccacgtgcgctaccgcgagatggcccggggcggggtgcgtctggtgcggacccggacctgggcccagctcgaactggagtccggccggctctacgaagaggccaagcacttggccgagtcccagcagctcaagaacaaggatatccccgaaggcggggccaaggccgtgctgctccttgatcccggggccgatcccaccctggcgctcaaaagcgccgtggacgggctgctcgacctgctcgtgcccggggacgaggccgatacccttcccggcgtggtcgattatctgggccggcccgagctcgtttatctcggcccggatgagggcatcaccccggaccatatccgctggatcgtgcgccgggccgccaaacgcggctacggctggccccgggcgtttatgagttccaagcccgagggcggcatcaaccacaagcgttacggcgtcaccagccttggcgtgctggaattcgccgacgcctttttgcgcgaggccggcattgaccccgaccgccaggaattcacggtcaagctgaccggcggcccggctggggacgtggccggcaacgccctgatccagctcttttcccgctatggcgaccgggccaaggtgttggccataagcgacggtcacggcgcggcctacgatccggccggcctggacgcggccgagctggcccggctggtggctgccgaaacctccatcaccggctttgacccggcccggctgtccggctcgcaagcctttgtcctggccgccgacacgccacaaggggccaaggcccgggccagcctgcacaacaccgtcgtagccgacctcttcatcccggccggcggccgcccggacaccatcaacgacgccaactggagcgccttttgcgacgaggccggccgtccctcggcccgggtcgtcatcgagggggccaacctctttttgacctccggcgcgcgccggggactggaagcggccggggtgctcatcgcgcctggcccctcggccaacaaggccggggtcatctgctcatcctacgagatcctggccggcatggccatgaccgaggaggaactggccgcctgccatggccgctatgtcgaggaagtgctggtgattcttggccgcaaggcccggaacgaggccgggctgctgctgcgcgaacgccgccgtcgcgggggcacgacgggactggtgggattgagccgcgaggcgtctctggagatcacggcccttaaggacgctctgagcgaagccatggcccggcaggccccgaccgtggccgacatcgccgccgacccgctgctgacagagcttattgccgcccactgcccgccgctggtggcggcgcgccacctggagcggctttttgccgtcgccccggcggcctatctccatgccgtggccgcggcccaggccgcctcaaccatcgtctatgccgaaggcttgggctggctgtctcgtctggccggcttacgcgacctcatggctattgtccgggcctatttcgcggccgccggggagctggaccgacgtctggccgccctgggccgaagccggatgcccggacgagacgagctggccggccttttggcccggtccgggcgcaagctgctgtgcgaacaggccctgggcctggatggcccggcagcgggcggggagagtgagggactctagatcttgatgggcggcagttcgatgcgcggcggcgtgtcccagatgcgctcaaggagccttttggcttcggctaagtcgggattgatggccagggcctcccgggcggtcttctcagcctcggccagattgtgctgctcgtagtagacccgcgcgatgttgagcagcaaatgatcatcggcgggggagagttcgcgggcccggaaatagtacttgagcgcctcgtcgaaaaggccttttttgcgcagattgatgccgaactcgttgaacaggtgcttgtggcgcggctcgaaggcctcttccatcctcaccaagcggtcgaagatgtaggaggccttctcggtcttgtccatggacagatagaccagccccaggccgaagttggcccggatgttgtcttcgtcgatgcgcttgatcttgaggtattcctgctcggcgctggccggcttgttggacgcccggtagtggtcgcccacgagcaggggttggctgagcaggcgatagctcaggtccggctccaggtggtagtcctcgaagagcttttcccgggtgatgcgaaaaggcgcgccctgacgcttgaagtccatgtccaggctctggacgtcgaaggcgttgtcctcgatttccttgacgaaccaatacgtctcggactgggctgtccgtttggtgacgccaaaacccaccgtaacggcggttttgagcgaaaagatgccgttgatccggttttcctggctcatgtcgcggcccgggcgctcagacgtccatggccagggcggcctggccggcgtcggctgcggtcgtttgcggggcttgggcgaggccgtcgtattgtttggcgcgcagcttggccaggagtttcgtggcctcggggaaagggtcgcgcaagctggccgcctgttccagatggtagatggcccggtcgtagtccttggcgaaaatgcaggccttggcgatgttgtaatgcaggttttcgtccttgggcgtcagcgtcagggcctgggtgtaggcgtgcagggcgccggggtagtcgccgcgctttcgcaggtcgatgcccagggaattgtaggggttgaccgcgtcgggattggcttgcaggatctcggcgaagagttccttgagctcggccagacgatcctggagagcgagaatctcggcggatttatcgagataggcccggtagttggcgtcgtcgcccttgcctttgtaggcgtgggccatgccctggtacgcctcggcgtacatggcgtttaaggccagggccttgttgaaggctacgatggccttgccgtatttttgacggtgcaggtaatccatccccttgttgaaccagacggtggactcgttttcctcttccacgatctcggaaaattcctgcaacgcctcgtcaaagcggccttgctgcacgagttcctgggccgtttgcaactgctcgacttcaacttcgtcgacgctggtggtctccagggccatttgcagatgccgctccagggtggtcatagaataggggcggatgacgtagccgttgcagccggcggcaatggccttgaccacgttttgcagcccgctttcggtggtcaccatgatgacgggcaagagcttggaacgggtggcccggcgcagggcgcgcaggcagctagctccgtccatgcccttgacggcggcgtcgatgagcaccacctggacggcgtcttccttgatgggatcaagcagatcgtcgagttcgtcggagacgatgacgtttttgatgttgagatcaagacagcacttcttgtctcgcgcggcatgatgcaggttattggtgaggatggcgacggagatgttcggcgtttccatgcttcgctcggtagtcgggataaagtgcgcctgtcttgcacgcggtccgggccggggaaagattgatgccgagcctggaggccaagaaagagcgggaattgtcgtgcattagaaagctaccatgcgtcggcggcaaaaccaagggaaaaagcggaagttcggcagggccgatcagacgcacgttgctgtgccgctgcagaggcgttccgcgctatgatttacactgcaacaatgccgtccgccataaatgtttatctgcaatggtcgggtctgtctcgggacttctggagcagccagacgccttgcctgctcgccgcgtcgatccggtgttgtgtcctcggaagaagcgtctgggtgtttcgtgggtgatatccataacatattgattttaataaacaatgccgacatttctagggacgcggcaagaggttgacgcacacccgcaaggtacgaccttgccttcaagctggctgccggttgcgccgcccgattaccaaccgccgcctccgcctccgccgcctccgccgccagaactcccgccgccgcccgagccggaagacgatcccggggccgtggatgaggcactgatggccgaggaaaaccccgagccgaggtcaccagcaaaaccgccgaagtccccggaactccaaccgtggccgacgtaccagaccggctggtagccctcggccgctgccagcgccaacacgtcggcgaactgggccgcccagtcgttttccacgtccaaggccagggcgtagggcaggtagcgttcgaaaagttcgggcgtgcgctccgggggagtaagcctgttgaggcgttcgcgctcgcccacgcggagatagagccgaaaaccctccagagcgtccatgacccgccggccttccctggtcggggccttgagcaagtggcgaaagatcgcggcttccacggcgatggcggcaaggcagccggctgccggccaggagacggcgatggaaaggaaggccagggcggccagctcgccaaggacgaagggtagggcgaacaaacaggcaaacgccgcgccgacgatgctcagaaagcgcggccgggccttggccttggccagggcctgcagggcgcgcatggtcagggcggccacgccgaagctccatacgccaagccatgccagggtcatgccggccatctccggctcgtcggcatggatggcgaccagggcaaagaccagcaggcaaagcgccacaccgacaaagaaatacgcccggttgatctggaaatggctgccctcgtaccggtccttgaggtcttcgcgaagagccttttgcgacgcccgcacggcttgatagttatcctgttccagacgcacggccggtgcgccgccaagcagggcgtcgaggaggccggcctgccaggaaccctcgggaaagcgcttcttgccgcgtccgacaatgtaggttccgtcgtcgtcctcgatgacggccccgccggccacggccatttccaccaccccggcggcgaaggccttgtcgtcatagcccatgcgccgcaggtagcgggcgcccggggcgctgacgccgtctgggggcgaaaaaagcggaatagtgatgcccttggccgggtcgcggccgacaatgagccaggccacgacgaaaaaaaccgtcaccaccaccagtccggcggcggcgaggtgaaaggcccggctcgtcaggatacgttcggttggcgtgggcagggtgacgaagcccttggggaagctcacggccacggtcaggcccgagcctgggggcaacggtttggtcgtttggcaataaaacgtgcccggcccggtctgggcggtgaaatcgcggcccttggccccggccggcccggtgtaggcggcccactgtcccggctgggccccgggcggcaggaagaccgtgactgatgcttggtcgatgggcagccgccagccgttgccggtgacgttccagtagagttcatcgtagtccgcgaactgcccaatctgaccgtcggttgcgtaggtcagctcataggtgtgttcgcccgggtcgaggagcttcccctttttgcccatgtagaccttgacgccgttgccggccgtctcggtatggtagtcttcgccacgtccgtctcggcgcacactcagaactttgaagcccgtcgtcacggtcttgccgtcgggcatgtcgtagcgggtggggaattcgcgcacgatgccctggcggatggactggccggcggccatgacgcgcagggtctcgaccacggtgagatcgcctgtgacggcgatggtcacccggctgtcaaaggacaggaggcgctcggactgggctgcggccgggccggccaggacaagcagcaaggccagagccgccagcatggcgctgtgggagtagaacgcgcggagtatgcgcgtaacagctttttgtccaaagacttttcggtttgccgccaagcgcctttctccagggcgcgacgcaagaacgccgccgggccgcaaggccgctcgtttcacgagccggctccggcgtcgaagctcacacgcggcatggcgcggtcggccggatcttcgatctcgaaatagggcagggggccaaagcccatggacgaggccagcaggttggccggaaacgtctgggaccggttgttctgctcccgggccgcgccgttgtagtagcgccgggcgagctgtatgtccgactcgatggcggccagttcctgttgcagggaggcgaaattctcgctggcccgcagttggggatagccttcggccacggcaaaaaaacgggtcagggcctgggtcagttcgccttccaggcgataacgggcggcttcatcggcagtgttctggattttcgtgcgcaggccggtcacggattccagtacgccgcgttcatgacccatgtagcctttgacggcttccaccagattggggatgaggtccgcccggcgtttgagttgaacatcaacgccgctgcgggcttcctcggccaggttgcggccccggatcaggccgttgtagagggcgatgccgtagaggccgataagcagggcgacgccgaggacgacggacagtgcgatcatggcggaactcctttgtcgggaaacggcccatgagccgatactgcaaggtcatacggaaaccggccggccaaggcaatggcttgttgcggccaagccttcccatgccgccttgccggtgctagacgggacgggcgacgggccaagaacaaggagcgagaaccatcatgggcgtaataggcatttgggaagaaggcgatggccggcagggcgttgatgggagccttggcgcgctgctgtcagccctgggccacgacgctcgcggccttgtcgccggactgcctttggctgccgagcttgaaggtttggtggcccaggccgggttgctcgcggctcacggcgaggcggtcgccgcccgaaaggctgcttcgggcgaggccgggtttccggtgctggccgtgctgccggccggagccgatgatgcggccgttgccgccgcttttggtgtcgccgacgaggtgatccgggagccggttgggccggcagagttggccggacgcctgggcaagcttctggagttttaccgccaagaggccgactgctgcgccttggcgctgtgccgggcgcgccaggaagcagccctggccgaggccaccgccgatctttcccgccgggtaagcgccctggactgcctgtccaaggtccatgccgtgatccagcggttcggccagccccgaaaccgcctcttcaaggacgtcatcgccttgctgcccccggccatgcgccgccccgaagcggctcacgcccgtctgctggtcgatgggaccgtttacgagacgcccggctttcgctcctgtgcccaaagcctgcgcattccactggctggctcggcccagcccgaggctgctttggaaatgcattacgaagcgcccgatccaaaacagccggacattgtttttcacgaggacgaggccgagttggccttgctcgtggcccagcgcctggggcgtaccctcagccggcttggggccgaggcggccctggcccgggagcgcgaattttccgccctgctcatggacgctctgcccgggggagtgctgcgcttcaatcgccatggggccatcgtgttcagcaatccccgggctgcggccatcctggagttgcaacagcgtgccctggcgggaaacatgttcgatgacgccgggttcggcgcggccaatgccgaaggccgtcccctggcccgggcagatcatccctttgcccgggtgctggccacgggcaagccggtttacgacatggccctgtccgtggcccgtccgggcggggggcggcgattcttgtcggtgagcgccgcgccgcttttcgccccggatggtggcatcgacgaagtcgtggtcaacatggtcgacgtcagcggccaaaaggcccaggagcgccagcttgcccatgccctcaagctcgaatccctgggccagctggccgccggcatcgcccatgagatcaacaccccggtgcagtatgtgctgggcaatctggaatttctggccaacgctttcggccgcctcatcgagaccttggacggcttggccgccgccgccctggacaccgagggcgacctgtgcctgaccgaggagctggcccggatgctggccgacgaggagctgcggttcctgcttgaggaatccccgtccgccatccgcgaatcccgggaaggcctggaccgggtgaccggcattgtttcgtccatgaaacgtttttcccatcccggcagcgagctgcccatggccgtggacgtggggcaggccatggccgacaccctggccgtgtcgcgcggggcctggaagttcgccgccgacgtgcgcctggacatcgacgcggggttgccgccggtgctgttcgtgcccggcgatctgcaccaggtgctgctcaacatcatcgtcaacgccgcccaggccattgaggagcagcacgccggaacgggcggcaagggacatatcgacatccgggccgtgcaaaacggccccgtggtggagctggccgtggccgatgacggtccgggcatgtccgaggaagtgcgccagcgcgtcttcgatcccttttttaccaccaagcccgtgggcaagggcacgggacagggcttggccctggtccacggcatcctccagcgccacaaggcccgggtggaggtgctgtccgccccgggccagggcacgagcttcgtcctgagcctgcccgtggccaatctgccggagatcggccgctagacacgcccggcctccgctttcgacgggcctttgccccggcggcgctgcggcgagccgtccgttgtttcgtaccagaaccagtcttcgggtccgggcacggccttgtgtcggggttgccgacgatcacggccggggataaagtcgagtctttgccgcatcatttcgacttgcccgacgccaggaggacgcatggccctcgaccccgctttttccgccgccccgggcgcccagggcgtgaccacgcccgtggtcgccacctgcacccgcgactgccccagcgcctgcggcttgctcgcctatgtccgggaaggccgggtggtcaaactgaccggcaaccccgcccatcccgtcaacaggggcacggcctgccgcaagacgccgggtttcctgcggcgcatgaccagcgacaaacgcgtgaccacgccgctgcggcgcgtggccggccagtggacgccggtgtcctgggacgacgccctggacgagatggccgagcgcctcaaggattgcgttgcccgccatggcccggagtcgatcctctactacatgggctttggcgaacgcacggcgctcaaaatcgtcaatgcccggtttttcgcccacctgggtggggtgaccacccttcgcggcacactgtgcggcggcacgggctacgccgcccagggcctggactacggcccccgcgtttcccacgatcccctggaccttcaaaacgcccgcaccatcgtcttgtggggcagaaaccccgtcgccacccagttcgggctcatgccgcatctgcgcgccgcccgggagcgcggggccagcatcgtgctgattgatccgcgccaaagcgaatccgccgccctggccgatttgctcgtgcagccaaggcccggccgcgacgcgttcctggccctggccgtggccaaacgcatcatcgaggccggttgggaggatcgaacctttctcgaaacccgggccgacaatctggccggctacttggccttgctggcccggtggagcatggacgagctggtcgccgcctgcgacgtgcccctggccgtggtcgccgccctggccgaggcctacgcccagggcaaacccacggccaccatgctcggttgggggctgcaccgcttcacgctcggccacgagatggtgcgcgccgtggacgcccttggcgcggtctcgggcaacatcggcctggccggcggcggcgtgtcccagggcttcgaggagtgggggccttacgacccggagctgtggggcgagggcctgcatccgccccggcgtaagctgctcatgccgcaaatcggccgggagattctcgaagccaaggacccgccggtggaaatggccgtcatcaccgccgccaatccggtctgcatggccccgaatgccgatctcgtggccaaggccctggactgcgtccccttcgtggtccacatgaatcttttcctcgacgacacggccgaacacgccgacctcttcttgccctgcgccgccttttacgagcagcgcgatctggtggcgagttttggccacaactacgtcgggccgctggtgcgcgccgtcgatccgcccgggcagtgccgcagccagttcgacatcttcatggaccttggccggcgatttccctttgccggggagtacatcaaaaccgaggaggagtggctgcggctgctcatccggccgcttttggaaaaaggcgtggcctgggacgacctctggaaggggccggtgcgcatcccggacgcgcccatggtcccctgggccgacggcaagttcgacacgccgaccgggcgtttccaactgctcacggaggtgacggcctgcgaggattgccgcgacgccgcccgctatcccttcacgctgctcaccgtcggcccggtggggcatctgtgttccgagcgcgagccgggctatgactcggggccgctggaaatcgccatggcctccgaagcggccacgcggctgggcatcgccgacggttcgccggccaagctcgtcagtccccttggcgagttggtcgtgaccgtgcgccacgacgagacgtcacgggctgatgtcgtgtcctgcggccgaggcggctggctgtcccacggccagggtgtcaaccgtctcatcccggacctggtcagcgcggtggggcagggcacgccgtattacgaggcccgtgtggacgtggagcggctgtcgtgatctcgcgcgaatggaaatgcaccctgccgcgtcgccaccgcgacggcttcatggagcacttgtatgccacgggcgtggccgagacctcggcgctgccggggtatcgcggctatcaaatcttggagcgcgagcttcccggcgatgtggccgaggtgacgcttgtcacgtactggggatcgctggaggatattaaggccttcgccggcgaggacataggggtggcggtgctgtatcccggcgacgaagtatatgaactcgtgccggagacggtggtgaggcattatggggtggttggggcggcgtggccgacgggtaaggagtagatgttgctggcgttggtttgtgtgtcgtgtgttagtttatggttttgtcaaggttcattttgcgattcataatttcaagaatttcctgtcttctttttgaagttggttcaaaatcaggaaatagctcaagtacggagttgcaaacagccagggcctcgtcaagtcgacccaattgtttaagggctccagcgcggttgtgttgggcaggaattaattcagggtcgaggctcaacgccatgtcgagggcggcgagagcttcttcaggccgattaagtgagttgagcgcagcaccaaagttgttccaggcatgcgggctttttgagtttatttgtaatgctttttctagagcaagcaaagcttcgtcgtattgtccatgcgtgccaaggatcacccctttgctgtaccatgcgccagcatcagagggattcaagttgagggcgatttcgtaggcttgaagagcttcgtcgtcgcggtcgagttgtttgagtgcatcaccttttttggtccaagtaatggcgacatctggatcgatatttatcgcaacatcgtatgctgtaagggcctcgtcaaatctgtcgagcttgtagagagctacgccctttgcgtgccaggccgccgcgtaatctgcgtccaggttggtcgctttttcatgcgcgtccaaagcactgctgaagtttccaagagcggaaagcgtcaagcctttgttgttccagtacatagggtattcttcatccaacagtatggccatttcacaagaagctagcgcctcctcgtaacgctggagatggaaaaggactagtccccgatcgttccatgacctgtcgtcgtcaggtttgagttctagagatttgtcgaaatatgtcagtgcttcgttgaaatgtcccattttcacgagagcatctgcttttccataccagaagtcattgtcttgtggagtcaatctcaagcctgtatcgaaagcggccaaggcatctttcggtcgatttgccttgactagatttctgccgatatagtaccatatgtctggatcgttaggagtgatgactgaagctgttgtaaaggccgctaacgaatcttcgtaccgattaagctttctgaggacaaagcctttgctgaacaaggcgtcaacatgatttttgtttaatagcaacgcttgctcatatgcagccagcgcttcttcgtactgttcaatgcgttctaaggatcttcctttgcgataccattcttcggcgtttttcatgtcagtgtctacggtttctttgtcaaaaaatattttttatcgtgtatttaatttgcgttgatctgacgttttgtcaagcgcaaaaaagccgccccgctgggtccgtgaacagcggggcggctaccgtatgggagtccaatccaagcggttggcaaaccggctctacgtgaacaggtggtcctcgcaggcttccccgttttccagggcgtcgagaatctcatccaccttgtcttcgctatcgatctctttgtaccaccagttgttgggcataaccaccacaaccggtccgtcttcgcactgcttgaggcaacccgtgctcaccacccgggcgtcgatgtcccggtcgaggatgccttcttccatgtagccgagcaggttgtgcgagccttttttgtggcagatgcccttggcctcgcccttgacgcgaaagctcgcgcagacgttgatcaggtattgcggcttttccatggtccctacgtctccctcgtgttgcgtcccttcacaatcctcgtcacatgccgtggtctgctttttatgtcccggtgtgacgtcctcgtgatcgcggttgtcgcgtcgcgaggacatcacaccggggatcggtcgttacagctggagttcgaagcgggtttcgggagcgtcgcggtcgagccgatccaggagcgcttccaggaacttttccatcagccgcatggccccggagtagcccaccgacgggaagtactggtggccgacgcggtcaaggatcgggaagccgtggcgcaccagcgggatgtcctcgtcgcgggcgacgtacttgaggtacgtgttgccgatgagcagatcgacggggtcgtttttgatccactggtggagcaggtacatgtcggcttcgccgccgcacttgaacttgcagtcgtaaggcacgtccttgagcagttcggtcatgcgctcgtcgaagtacttaccggcggtgcccgtgaccgtgtaggccgggatcatgcccagggtgatgcagaattcgaccagagccagcacctggtcggggtcgccggccatggccactttcttgccgtagaagtactggctgtagtcggagagcaggtccacgacctggccgcgctcgaagttgatggagtcgggcacggtcttgccggagagcttgcgcagcagatcgacgtagcggtccgtggccttaagcccgatgggcaggcccatgacgtggccgggcaccttgaactcggcgtccaggaagttgacgccgtcggcggtggcccagcggccgaggccaatggtggccttggcgtcgcccatgccggcgatctcggccggggtggctccggcgttggggtacatttcgtaatggccggtcatggggccgttgagcacgccattggtgtccgggaccatggtgatgtcgatgcccatcatgtcggccaggcggcgcatctcggccatgtccgacggctcgcaaaagccggggatgatgttgatcttgccgttgggcgtcccggtctttgtgacaaagcccttgaggatgcccttgaccatgttggcgtagccggtgacatgggtgccgacgtagctcggggtgctggcgtagacgatgtgcttgccggccggcaccttgccgtcgtccttggccttctgggagatctgcatcaggtcgtcgccgatggtctccgagaggcaggtggtgtggatggcgatgacctcggggtcatacagggtgaagatgttgtcgatggcggtgatgaggttggactggccgccaaagaccgaggaaccttcggtgaaggaggaggtgccggccacgaccggctccttgtagtgccgggtcagggcggagcggtggtaggcgcagcagccctgggaaccgtggctgtgggggaaacatcccttgacgccaagggccgcgtacatggcccccacgggctggcaggtcttggccgggttgacggtgagcgccttgcgttccttgatctcgccggtggtgtgtcttaagagagccataatgctttcctttctcgcaatcgcgtgcgttgctaggccacgtaggtggcttcgagctcgggaccgtcggcctgccagggagccttgataaggttccagaccttggtgttcaccatgcggtcgatatcgcggtaccagttgatggcgccgttgaacccggcgtagggaccgcccatgtcgtagttgtgcagctgcttgagcggaatccccatcttctggacgatgtacttttccttgatgccggcgcagaagatgtcgggcttgtagatctccaggagcttttccgtctcgtagtggttgatgtcgtcgatgaccatggcgtccttgcccatgccgccgatcatgccctcgtagcccttgaagtccaggccctgctcgttgagcttggccagttccgcctcggtcttgcggggcttgaagcgctcgggatcgggatggatttcgagctcttcgatgttgcgcgagtcggcgtcgatcttgatggtcggcagcacgtggcggccttcgtagtcatcgcggtgggcgaactcgtagcccgcgcccaggatcttcatgcccagttccttgaacagttcctggtagtggtgggcccgggagccgccgacgaacagcatggcggtcttgccgtccgtgcgcggcttgatttcgtccacgacggttttgaccttttccagctcctcggcgatgacggcctcggtgcggtcgatgagttcctggtcctcgaagtaggcggccatgcggcgcagggacttggccgaggcttcagccccgatgaagttcaccttgatccaggggatgccgtacttggtctccatcatttcggccacgtagttgagcgaccggtggcacatgacggtgttgaggtcggcggcgtgggcgatgcggaaatcttccacggtggagttgccggagaaggtggcgaccagggtgaagccgcacttttccaggatgcgctcgatctcgaaagcgtcgccgccgatgttgtactcgccgagcatgttgaccttgaacttgccctcgacttcgacgtctttggtgccgatgacatgcttcatgatctggttgttggcgatgtggtggccggcggactgggacacgcccttatagccttcgcaggagttggcgaagatggtgatgcccagctcttcttgcatggtgcgggccacggcgtggatgtcatcgccgataagaccgaccgggcaagtggagaagatggaaatggccttggggtggaagttgtcgtaggcttcctggatggccgcgcgcagcttcttctcgccgccgaacacgatgtcgtgctcggtcatgtctgtggaaaacgcgtaggggatgaagttctccccgtccggaccggcgtcggtctggttgcggcgggtgagccaggagtagaagccgcagccgatggggccgtgggtcaggttgacgatgtcccgggaggggccgagaacgacgcccttgcagccggcgtaggtgcagccgcgctgggtgatgatgccggggatggtgcggacgttggactgaatttcgggaatcggttcgccgacctcggtgcccgggaggatggacttggcccgcttgcgcgcgaccttggtgggcatcttggcgatcaattccttcttgatctcttcgacattggtgggcttggtgctcatctcgctgctacctcattggtcttggggtccgggaacgtccgccaaaccgggctagacgatggccgcttcgccggcttcgccggtcctgacccgcacggaatcggagacgggcataacgaagatcttgccgtcgccggcctggccggtcttgttgacgctgataagagcgtccacagcttccttgacctgatcgtcggggaccacgatggatatgatgcgcttggggtacaggcggcccttggtgcccagaagcgcgatggcttcctcgttgccggccgcggcgccgtcaagcaccgcctggttgaccagacccttgccgcgtccgtagccctcgcgggccacgaaggccgggatgcccgcgtcggccaaggccttcttggtctggttcatcttattcatgcggatgaccgccataatctccttcatgacgcgcccccttaggcttccttgacgccggaggagatggtgtacatctcttccaccgggctcacgaagatcttgccgtcgccgaaggctcccttggaaccgctgcgggcgctctccatgatggttttgatcacgaagtccttgtcgcagtcgggcacgacgcagatgagcatgaccttggggatctcgtcgtactggatctcgccgatcttgatgccgcgctgcttgccgcgaccggccacgttgaacttggtgacggcggggaacccggcatccatcagggcggacaggacttcatcggtcttctcggggcggacgatcgctctgaccatggtctgcatatgaaatactccttgcgtgtgtgcgttgtgtgtcggggcagcggcgcgactagttggcgatgccgaagtcgacgagcagcttttcgagctgggcgatttccaggggcttgggaatgaccagcatcttgttttcgtcgatctttttggccagggcccggtattcgtcggcctgggcgtgctcgggggagtagtcgatgaccgtcttgcggttgatttcggcgcgctgcacctgattttcgcggggcatgaagtggatcatctgggtgccgatctggcggcacagctcttcgatcatttccttttcgaaatcgaccttacggctgttgcagatgatgccgcccaggcgcacgccgccggtgtcggcgtacttcacgatgcccttgcagatgttgttggcggcgtacatggccatcatttcgccggagcagacgatgtagatttcctcggccttgccgtcgcggatgggcatggcgaaaccgccgcacacgacgtcgccgagcacgtcgtagaagacgtagtcgagcttcttgtcttcctcgtaggcgccgagctgctccaagaggttgatggaggtgatgatgccgcggccggcgcagccgacgccgggctcggggccgccggactcggtgcacatggtgccgccgtagccttccttgaggatgtcatcgagttcgacgtcttcgccttcctcgcgcagggtgtcgagaacggtcttctgggccagaccgtgcaggagcagacgggtggagtcggccttcgggtcgcagccgaccaccatgaccttcttgcccatttccgccagcccggcgacggtgttctgcgtggtggtggacttgccgatgccgcccttgccgtaaatagcgatcttgcgcattttgtaatgcctcctgctgcaaagttggaatgtctctctttaggcaagagtcatgccagtgtgtgccaggcgtgatactttttcgataacttatcgatataatttaagatagctgattcactcgagctttgatttgtcaaccggaattggttgcaaacatttttgttgcgtttggcgcgacaaaaatgttcgacataaatgtcgcaagcaaaatgtccagggatgcaggggagcggtcacgaatggccgctcaaggaggatgaggagctatgcagcgggtgattgcttctgtacttcagggtgttgcgctgcgaggcaggctccaggaaaggaagccgcctcgcaggcgaagagggagaggggcagggttgatttgacgaatatggaaatgcgccgggcgaagaatccaatgatcctcaaggcccgactgcagagtgcgacttccgccgggcaagggccgctctccaggccgggcggtcaggctttgggagcgccatgaacgtgcgccgccgggcggcggcgcggatcaggcccgttatcccgtggttgcttgcggctcggacttcatgctcaggctcagccgcccccgctccttgtcgatggccagcaccgtcaccatgacctcctgcccggccgccaccaccttggccggatcgaccacgtaggcgtcggccagatggctcacgtgcacaaggccgtcgcggtgtacgcccacatccacgaacgcgccaaaggccgtgacgttggtgacccggcccggcagccgcatccccggacgcagatcggccagttcgctcactccctcggcaaaggcgaaggccgaaaacgtggggcgtgggtcgcgcccgggcttggccagttcggccaggatgtcgcgcagggtctccaggcccacgtcgccggcgacgtagcgggccggctcgatgccttcccgcaggctcgccttggcgatgaggtcggtcacggcgcagcccaggtccttggccatgcggccgaccagggcgtagcgctcgggatgcacggccgtggcgtccaggggcggcccgccgcgaaggcgcaaaaaaccggctgcctgctcgaaagccttgggaccaaggcgcttgaccttgcgcagttcggcccgggatcggaaagggccattttccttgcggtgggccacgatgttggcggcaaggcttggccccaggcccgagacggcggtgagcagctccacgctggccgtgttgagatccacgcccacggcgttgacgcagctggacacgacctcgtccagggccttcctgagggcggcctggtccacgtcgtgctggtactggcccacgccaatggatttggggtcgatcttgaccagttcggccagggggtccatgagccggcggccgatgcttaccgcgccccgcacggtcaggtcgaggtccgggaattcgttgcgggccgtttccgaagccgagtagatcgacgccccagcctcgttgaccaggatcaccggcacgcccaagcccaggtcggccacgaagcgttcggtctcgcgcccggccgtgccgttgcccacggcgatggcctcgatggcctgggcggcgcacagctggcgcagggtctcggccgcctggtcgcgctggcgctcggagccggtggggaagatggtctcgtagtggagtaggttgccctgggcgtccaggacggccagcttggccccggtgcgaaacccggggtccagggccagcacccgggcctgtcccaggggcgcggccaggagcacttggcgcagattggccgcgaagatggcgatggcctcccggtcggcccggtccttgaggctggcgcgcagttcgttttccagcgacggcccaagcaggcgcttgtaggcgtcggcggccgcctcggccacctgttcgctgtccttgccccggcccgtgaccaccaggcgcgtgagctggcgcagggcctcgtcctcgaccgggcgcagggaaagggccaaaagcccctcgcgctcgccgcgaaacatggccagggcgcggtggccggccaccgcgcgcacggcttcgtcgcgctcgaagaaatcccgatagttggcggcgtctgcttccttgcccttgaccagacgcgagacgatgcggccgcgcttggcgaaaagatcgcgcaggacggcccggttggcggcgtcctcgcttatggcctcggccatgatgtcgcgcgccccggccagggcggcggcgacgtcggccacgtccttttcgggattgacgaaccgggccgcctctttttccgggggcacgccgcgttggcgcatgagcagttcggccaggggctccagtccccgttcccgggccatggccgcccgggtgcggcgcttggggcggtggggcaggtagaggtcttccagccgggccatgtcctgggcggcctcgatgtcccgggccagggcgtcggtcaagaggtcgcgttcggtcagggattccaggatggcggcccggcgtttgtccaggtcggccagttgttggaggcggtcgcgcacggcggccacgaccacctcgtccagggagccggtggcttccttgcggtagcgggcgataaacggaatcgtggccccgtcggcgagcagtccggccacggccgccacctggcgcggggcgacggacagttccttggcgataagggcggcgtgtttttcggtcatggggagcgcctccgggcgcgacccgcgcgggtcttggtgtcgcgccctctataaaataccatggtattttttaaaaatgaatgattttaagtctttgtcctcgaaagagcagaaacgttttcgtggacgcgacacgaggcttcaggccgtcgcctcgggagggccgacataacagtcaccgggccttgcgggcaagggcagggcggctcaacgccttgaccttcccttggcaacacggcggacagcttgtagttttaccccactttcgcggcaacgcgccgcccacggagccgtccatgcccaatctccccccgcgccaccagccctacaccgacaaatacttcctgcgctcgcgccatatcctggaaaaagaaggcctcaacccgtggattacggtgcaggtcttttttcgaaatggtcccgggaaaatcgccggcgttggcgaggcggccgccgcgtttttggcctattcgcccttgatggagcatggcggccaggtctgggccctggccgagggcgaggccttttcgcccctggagccggtgatgcgcatcgaaggccccattggcgacgtcatcgagctggagacgttctacctcggcatcctgaccgcccgcaccagcctggcaaacgacgttccccggcccgatcccctggccgcaaccgccaaggcggcggccctacgccagatcttgccgggcaaggatctcctgtatttcggcgcccgccactggcactggtccctggaagaggaactctgccgggcggccgtggccggcggtttcgattcctgcgccaccgacgccggcgcccgggccgccggcctgcccgccggggtcggcaccattccccacgccctggtcctggccttcgcccatcgcttcggccccaagcgggccacccgcgaagccgccctggcctttgaccgccacatcgagccgacctgtccgcgcatcgcccttgtcgacaccttcaacaaggaaatcgacgacgccctggacacggcccgggcgctgggggagcgcttgtggggcgtgcgcctggacacctcgggcgaactgatcggccagggcggcgcgacctttgacggccgcccctacctgaccggccccggcgtcaccgtggccggcgtgcgggctgtgcgccaggccctggatgcggccggctttgcccacgtcaacatcgtgctgtccagcggctttggcgatccggccaaggcggccgcctttgccgccgacgaggcgcgtcatggccggctgttcgaggccgtgggcgtgggcggcctctttgacgcctggtacgccaccgccgacatcgtgcgcatcgagggccagcccctggccaaggccggccggagcttgcgcgacaacccccgcctgcggcgcgttgtgtgagaggtgtgggaaggaggggaagaaaaagaggcctcccgcggctgggggcctgaggcccccagaccccccatctgcagaaatgtttaaagggtgtcggcgtggattggttctctggtcggctgagtagtatcgatagggttgcttcaaggagtcgggccatggaagatctgttgatcgtggtggatatgctcaatgatttcatccaccccgacgggaagctctacttccccaaaggtgcggccgtggtcgaggcgtgcgcgcggctgcgccgggccttccgtgacgccggcttgcccgtggtccacgccgccgacgcccatccggtcgattcccgggagttcgccgactggccgccccattgcctggccgggtcctggggcgcgcgcgtcatcgacgaactggctccggcagccggcgaactcgtggcccacaaggacgccatgagccttttcagccatgccgctgtggacgggctcctccagggccttggcgtgaagcggctttggctgtgcggcgtggccaccgaatactgcgtccaggcctgcgccctggatgcggcggcccgggactacggcgtgacggtggccgtcgacgccatagccggcgtggacatgatgcccggcgcgtcccaggcggccctggaggccatggcccgggccggagtccgtttggtctcctgcgacgacgtgctgtccgctttttaaacagtggacgttgccgcccaagcgagattaaggacaagctgaagtccctgctccctccggctcggaagcctgacttctggccgggcgttctgtttgcatcgatcgtccgacacgccagcaagcccaaagcggaggggttcccatgcctaatagagcgtatctttgccgaaagccgcctgttgcttttcctgcaattgggcaactcgtcctgcgttgcctgctgctcgccctggtcctggttctgggcctggggcagaccgcctggaccgcccaacccgccccggccgcgagcgcggccagacaaccccgccaaagcgcctgggaattcgatcaggttgggctgaaaggcgtgctctatccgtcgctcatgctctgcatggccaagatgcaggtgaatccgcagcaacaggacggcgaactgggcgacgccaacggtctgctcggcatttcggtggtctcgccacgcgccggggccaaggccgtggtggagttgacttcctcctcgcccctggtccatcctggtcgggtcgaggtggccttgccgcaaaaaggcaaggtgtatcaggtgtttccttatgtatccatggacgaggccgtcgtgttgcagcgtcatgcctcgcctgcgactctgacggccaagctttggctggacggcgtcccccagggggagcgttcggctcaggtctccatcgcttccatcaatgactgcgtgttcggcttgaaggacgatgagacgtattatgggacgctttggctctttgccgcctacgtcaacgagaaccacccggccgtgcagcagattttgcaagaggccctgacctctcgggaggtggccgcttttaacggctaccaatccgatccggccggcgtgcgcaagcaggtcaaggccgtctggcaggtgttgcgacggcgcggcatccgctattcgaacatcgaaaaagcgtccgtgaagcttgatgacgtcgcggtgcagcatgtgcggtttgtcagcgacgccttgttgtcgcggcaggccaattgcgtggaaggcagctgcctgctggcctcgattttcacgaaaatcggcctggagacatggcttgtggccttgcccgagcatatgctcgtggccgttgccctggacccgcaaggcaagcagatgctgtatctagaaacaacgctactgagtgaatcgactttcgaggacgcggccaaggccggccagctccagatggatgaggtctacgccaaggcgcgcaaggccgaggcccgcaaaaaagccggcaaggccggcgacgaggaggacgcccaagagccgtacctgatttccataagcgaggtccgcaagcgtggcatcctgccgattcccgacaccgaggaagccaggaaacggttttttctgacgaaatagccgattgaaaccatcgtaaccagtcattgcgttgtgaaatgcctggaattcgctccctgcgagggccgctttggagtttttggctgtcgccggcagtctcccttacggacagccgtggtccgcagtggatggatgttgcgaacaaaaagagcttcactggcgggctaatgccgttgccgctttgttgccgcaacgaagaaggggtcgcgacttacatcgtaaccccttgaaatatggtgggcaatacaggattcgaacctgtggcctttggctccggaggccaacgctctatccaactgagctaattgcccaaggaaggaagcttttacgcgccggcccagcggatgtcaacaaggaaatcttgctgtcctattccggtttggggaggggataaagcccggctccagcagcatggtgtcctgggcgtgtcttccagccaccttcccggctttggtccggactaaccggcctggaccgcgctcaaggcgtccacgctgcgggtcaccggtccaagggacgtacagacctggttcctgcccaggtgcttggcttggtaaagcgccttgtccgctttttccagcagatccttgcgccgggtcaaggcgccgggctgcaaggccgagacgccgatggacacggtgatggaaaagtcctcgccgtcatggacgaaacgcgcttcggcaatggcgcctcgcagccgctcggccaggattcgcgcctgttcctcggccgtctggggcagaataaccacgaattcctcgccgccgtagcgggccgtgaaatccgtgctacgaagggtttccgacaggatgctccccacctcgcgcagcacgtggtcgccgaccaggtggccgtagcggtcgtttatgcccttgaaatggtcgatgtcgaccataagcaggctcatggcatggcggtagcgctggtggcggcgcaattcgtcgatgaggcgttcatcaaaggcccgacggttgtggatgcgggtgaggccgtcgtggtcggcccggatcttgacctgattgaagagggcagcgtttttcagcgccagagccaaatggttgatggaagcgtagagggcctggacctgatccttgcccagggcgcggcctttggctcggtagagcacgagcaggccaaacatctggccgccggcccgaagcggcaaggtgatgagatcttcaggggcggtcgggacgccgaccgactcgtggtcggctccgccgtcgaggaagctggccttgtagctgtgcatgggcttgccggcgagcttggcggcctgacgcagcaactgctcggtccagtggcgttcggccgtttggtccatgtcgggttccaggaacagttcggcttcaagattcccgccttcgccggtctgccacagcgcgcccatgagcgcctgcaggggcagaagcagctcaagatcctcccgagcgttgtccaggatcacgatggggtccagggactcgctggcccgggtgagaatgcggttgagaaacagcacaagatcggtctttcgggccagaagctcgcgctccagcatgatctcgcgggtcatgcggaaaatgtcgtcgtacaggctcttgacttccttggcccggaagatgacgtcgcggatctttttgtcggtcagcggctcggacacggcggacaaaaagccgttttccaacacgtcctcgaattcggccacggactgggtggccccgagcaccaacacccgttggggggtctcccattcctcaatgatcttctgggtatcaaggggcagggcgtcccaggcttccttgaccacaaagacgacaaggggcgcggcccgagcgatgtccctggcgccgggatggctgcccatgggccagttgcgcagcacgtaaccggctccaagcgccgaactcacggccgtcgcggcctcttcgccaagtccgatgccccacacatgttcggggcggattccgcgcgtcatggctgcctccttgggtcagggccggcacaatatgcctgcccgacacgctctttgcaaaagacagtccaaacagtaataggctgcgccgtttgacaaccggcccaggctgtggctccctggctccatgcaccccccccgtatcttcgctacgttggacccgtttatcgaaggggccgacatcatgggcagaaaggtggccaacgcggcctttctcgatgccctggcccggcgcgatccctttgacgcctaccactttttcatgccctccgagcgcgagcgccagcgccaggaaggtctgctcgccgcccgttatccggccctggccgggcgcggcgcgttcaaagttctgacgcgtcaggagctgccggccgccctgggaaccacggactacgcggtctttcacctctcggattgcctcactgcccaggcccgtctggccgctgcccggaacgctctctctcgagtgatctttcccatcaccggcggcatccattccctaagctacgcccactatcagcgcgattttctggcccatctcgcgcccgcgaccacccggcgcgacgccatcgtgtgcacctcgaaggccggccgggaagccgtgacggctctgtttaaggccttgcgccggggctacggtctctcgcccgaggcttatcccgcgcccgaactggccttgatccccctgggcgtggagcccgacgactggcggcgtcttgacggccaggaacgcgcggaggcccgggccgcctggggcatcgccccccagggcacggtgctcctcatgttcggacgggtttcccacagctccaagatggacctgctcccgctttttcgggccgtgcagcgtctcatggcttccggcctggatgtctcgaacctgatgctggtggtggccggctggaccgatgacgacgatccgtttttggggaccctggccgccttggccgccaacgtgggcctgcgcctggttctggtgcgccggccggacgaggcggccaagcggcaactgttcggcctggccgacgcgtttgtctccctggccgacaatccccaggaaacctttggcctcacgctcctggaggccatggccgcctgcctgccggtggtcgcctcggactacgacggctaccgcgacatcgttgcgccggggcgcaccggctggctgttgccgacgctggggctgccccggtccccggcgcgcgatgtgctggctccgctgtgctacgacaaccatacccatctgcgcctggcccaggctacggccgtgtccgtgccggccctggccgaagcgctggccactgtccttggcgatcccgataaggcccggggcctgggtgaggccgggcgcgagcgggccgtggcgcaattcacctgggacgcctgcgttggccgccatctggagctctggaaacgcctggccgcgcagcccgtgccggatcgggaccagttggccgccacgccccatccctggaccctggcctacgacgaggtctttgctggttatccctcgggcaggcttggcgacgacctgcggctggtctggacccgggccggccaggcggtctaccaccgccaggattttccggtgatctacgccgagctgtcccgggaggtgcggcccgaggctctgcgggtgctggtctttctggcccggggcggctgtccgggcctgaccctggccagacgtctggctgcggccgtgccgggactcgacgaagccgccgccgtctggcatgtgctgtgggcgctcaagcaagatttgctcgaagtgcaaaaggagccggcatgacgcgccccatgggccatgacacgacagagcggggcgatgggttcgccccggccaaacgcagcctgggccagaattttctggtcgatcccaacgtttccgccaagatcgtggcccagttgcggatcgggcctgaagacacggtcatcgagattggccctgggcggggagccctttcgggtcatatcctggccgccgggccgcgcgcctatctggccctggaaaaggatcgggaactggccgcccggctgccgcgcgagcatcccggggcccatccggccctggtcgatgccttgcgcctggactggtcgcgccttgacgccttggacggcgccaagctggtgggcaatcttccctataatatcgcttcgccgctgttgtgggatatctgctcccaggcctcgcgctttgccgtgggggtcttcatggtgcagcacgaggtggcccttcgcctgtgcgccgctccgggcggcaggcagtacggggcgctgaccgcctggacgtcgtcgtttgcccggttcgattattgtttcaaggtgtcgcccggggtgtttcggccccagcccaaggtggattcggcggtggtggccgtgactccccgggcgagcaaggaacggcccgaggacccggccggcctggcgaccttgctcaagcggcttttttccatgcgccgcaagcagttggccggcatcttgaagccccactgggacgaggccctggcccaggcatgcgccgggcacggcatcgaggggcgcgttcggcccgaaaccttgacgccaggccagttccagcagctggccaaattgctgaaaacgcgcttgccctcttgactttggggctgaaatcgattttggtttgcccactcacgtgcgtcgcgtcaggccggaaacggcgacgcaggggcaggagggccgtccttgccgcggggaggcgagggggggcgtccctgttgatgttgacggaacgcgccggagtgatttgcgagcatagcgccgccgccaggccggaggcgatcaaccgaggaggagaggactgatgaccaaggctgatctggtaggaaaaattgccgaaaagacagggctgaccaaagccaacgccgaacgcgccctcaacgcctttatcgaggcgatcgaggaaacgctggttggcgaaggcaagatcacgctgacggggtttggcaccttcatggtggacgagcgcaaggcccgcaccggccgcaatccccgcaccggcgccgagatcaatatcccggcttccaaagtcgtcaaatttcggccgggcaaattgctcaaggacgctattcaataaccaatcgcgggagaagctcacatgttacacggcgaaaccgtccacagccccctgccgcaggacctcccctggtggcagcccgatcatttcgtgtttttcagcgtgctctacttggtgctcttcatcatcgcctcgggcatgggctattgcatcttcaaagcctaccaggacaccaagaacgccccggctcacggccaccactaagtcttttcccggcctcgggatcgcgccgccgcccggcttgccgccgggcggttttgtttggcgtgtgggggcctgcgcctttgccgggcgctgaacctgtcggggacggggatgtcggcgcttttatgggaaaacgcttggcgcttttccagaccagggcaggcctcatccggcaggggaggcggcggttgaacgacgggatcttttttgacaagacgtggattgcctcccttgacagggaggagtgcgtcgggtaaatgaccctgctttaccgcgagggaatttttcaaagagggggtgatgtgaatgcccggtgtctaccttgaggagtccgacaactttgacgtggccctgcgccgcttcaagaagcaggtcgaaaaatccgggattctctccgagctgaagaaacgtcagcactttgagaaacccagcgtcatgcgcaagaagaagaaggccgccgctcgcaagcggttgctcaagaaaatgcgcaaaatcaacatgatgtaatgaatctcatagcccgtatcgaatccgactacctggcttccatgaaggccagggacgagttgaccctcggtgtcttgcggatgcttaagtcagccgcgaaaaaccgtcaggtcgaactgcgacgccctttgaccgaggacgagtattgcgacgtcctggccaagcaggccaagcagcgccgggagtccatcgaacagttcgccaaggcgaaccgggctgatcttgtcgaaaaagaggagcgggagctgggcgttttgctcgcctatcttcccgctcccttgaccgacgacgagcttgccgccgccgtcaacgccgccgtgaccgaccttgccgccgcctccatgaaggacatggggaaggtcgtgcaggcggtgctggccgctcacaaggggcgggtcgacggcaagcgggtcagcgacgccgtcaaggcgcgcctcgcttcctgacctccccgaatccacattttcttatggaatccagaactctttcgttgctggagtttccgaaggttttggaccggttggccggctatgccgcctcggaaccggccgccgccgcctgtcgggcccttgggcccatgggcgatgccgcgcgtttggccacggaacagcgaaagctcgtcgaggcccttgagctgcgccgcgaccgggccttcgaattcaccgcttttcccgacatcgagccgcttttcgccgtactcgaaagcgaacgccgggtcctggacctcgatgcgctggtcgctctttcccacgtgctgtcgcgggtggccgccctgcgcgaagccctgggccgcgaagagggcgactccgtactcggcgctatcgtctaccgcacgccctgggccaagaagacccaggccgccctggcccgttgcctgggcccggacggacgcctcaaggacgaaagctcgcccgagcttttctccgtgcgccaggaaatccgctccatccaccagaccatcctgaccaaggtcaaggagttcatctccgagcgcgagctggggccgcttttgcaggacgattacgtcaccatctcctcggaccgctacgtcctgccgctgcgggccaatttcaagggccgcctgcccggcgtcatccacgactattcccagaccggggaaaccatctacgtggagccctttttcctggtggagatcaacaatcgcctccaggaactcaaaaacgaggagcgcgaggccgaggcccgggtcatggcctttttgaccggcctggcccgggacgagcgccgggaagtggcggcctcctaccgcctgctcgtggattgcgacgtgctgtgggccaaggccgccttgtgcgatgcctttggtggcacgctgcccgaggtcgcccagggccgggccgtgcgcctgctcgccgcccgccatcccctgctggccctggccggcccggattccgccgtggcccaggacctggaactggcccccgaccaacgggcgcttatcgtcactggggccaacgccggcggcaagaccgtctgtttgaagaccttggggcttctggccgccatggccctgtcggggttgcccgtgccggccggggagggcagcagcctgccctttttcgccaagattttcgtctttctcggcgacgagcaaagccttgaggaccatttgtccaccttcacggcccagatccgccacctctcgcgcgtctggccggacatcgacgcggacacgctggtgctccttgacgaattcggggccggcaccgacccgtcccagggcgcggccttggcccaggccgtggtggacggtctccttgaccggggggcctatctggccgccgccacccactttccggcgctcaaggcctacggtctgtcccgggaaggcgtgcgcgccgcctgcatgctctttgatccggccaccaaaaagccgctctaccgtctggcctacgatcaggtcggggcgtccatcgccctggacgtggcccgggagcacggcctgcccgaggacatcctggagcgggccaaccgctatctgctcctggacggcaacgacaccggactggtgttcgaccgcttaaatgacctggccttgcgtcgcgaacacgagctggaggccattgccgccaagcggctggccgaagaaggcaagattcaaaagctcaaggacaacttgaagaaagctcaggacaagctggtggaggaaatccgcgagctgtcccgcgacatcgtgcgtcgccacgaggccggacgcctgggacgtaaggaagcgcaaaaggcccttgccgatgttcgcaaaagacttattgatgaaagcaacgaattgaccgggggacccggaggcgaggccgcggctgtggccttcgacctgtccgtcgtggctcctggcgattcggttcaggtgacaagctggaacaaaatcggcgtggtgcgggaaaaagacctcaagcgtcaggccgccaaggtcgatattggcggcgtgagcctgtgggtgaacgtggctgatctggccccggccgccggcaaaccggccaaggccgggggcggtgcggtggtgacgccgacagcctcggaggccaaggggctggggttggtggtcgatttgcggggaatgcgcgccgacgtggctgagagcgagcttttggcctttgtcgacaatgcgctgctgcgcgggcacggcgagctggaggtcatccacggtcggggcaccggggcgcttaggcgtgaggtgcatcggatgctgaaggaccatccccaggtcgcgtcctttgccatcgctcccgaggatcggggcggcgacggcatgaccatggtgacgctcaaataagcgtcggcattttttgttcgcttcgccggcgggagcgagcaacccttgggcggccccgggccgcttgcaacgtttgtctggccgggtgcgatgaaaaatgattccggggccgtggcggcggtcaaggcccgggccaacatcgccgaaatcgtggggcgttatgtgaccctgcggccggtcggcagccggctggtggggccttgtccgtttcaccaggagaccaaggggtcgtttaacgtacatcccgacaaaggctttttccactgtttcggatgccaggcctcgggggacgtgattgattttttttgccgcataaacggcctggagtttcgtgaagggctggagcggctggcagccgaagtgggagtcgatctcggccgggcgcgcagcgacccgcgcgcggcggccaagaagcgcgaacgcgacgcttgcctagccatgcacgagctggctgaccggtatttccgccacttgcttggccgggacgaaggccgggtggcccgggagtacctggaaaggcgcggggtcagcgccgagatgatcgagcggttttccctgggcgtgagccccgagggctggcagggcctgcaaaccgtgctgcgcggcaggggctttgacgacgattcggccatcatcgcgggccttttgacccagggcaagaacgggcgcacatgggaccggtttcgcggccggctcatgtttcccatccgcgacggcggcggccgggtcatcgcctttggcggccgggtcatgggcgagggcgatccgaagtatctcaacagcgccgaaacccccatctataccaaggggcagcatctttacggactctacgaagccaggccggtcatggccaagacccggcgggcgcttttgagcgagggctatctcgacgtcatcaccctgcaccagttcggctacggcgaggcctgcggggtgctgggaacggccatgacccatgagcaggccaagcgcctaagcgggttcgccccccgggtcgatctggtctttgacggcgacgcgcctgggcgcaaggcggccttgcgggcggcccagatgcttttgacccttggcggagcctgccgggtagtgcccctgcccgacggcgaggacgtggacagcctgcttcatgcccaggggcgcgacggattcgaagcctgtctggaacgggccgaagacggactcaatttctgtctgcgcatggtgcgcgagagctacgccccccgggagatcgtggcctgggccggggagtttttggggggcctggccgacgagggcctgcgggcgctgtttattccgcgcgtggcctcggggctggggctggccgaggccgaactgcgacggctgctttcccgaccggccaagaggccggcccccgggccacggccgggcgagacggccgcgccgcgccagccggcctgggagctggccccgcgcgacgcacagattttgtcgtttgtcgtgcgccggccggactatgcggcgcaccttgccggagccggggcgggcgagcttttgggcaacgccgacgcccggctgtttttcgccagattggccggattggtttcggacgaggccgaggcgcgcctgaccgagcccgaaaccgccttttgggccaaggcgcagatggaaccgcccgtgtccgacgaggacgcggcggcgtttttcgaggaactttgcgtatttctccatgaggcgcgggagagcgaccggcggcggtccgtcatggacgccatccgtctggcccagcaacggggagacagcgaggaagccctgcggctactcggggaactgcaagccctttccgggaggggagatgagtaatctcaaagagatccaacagatcaaaagcctcatcatcaaaggcaagcaaaaaggctttctcaccttcgacgaggtgaacaaggccctgccttccgaggtgaacaaccccgagcagctcgaagaggtcattgccatcttcgatcagctcgacatcaacctcgtggacaccgacaaggacggccgcaagatcgaagtggccgccgccgagccagacgacgccccggacgccgatctggaactgaccgaaagcgaggattccctcgactattcgtcccgcagcaccgacccggtgcgcatgtacttgcgcgagatgggcgctgtgccgctgctcgaccgcgagggcgaggtggtcatcgccaagaagatcgagaacggcgaaatggaagtcctctacgccctggtggaagtgccggtggccgtggaagagctcatccaggtcggcgaggacctcaagatcggccgtatcaagctcaaggacgtggtcaagaccatcgaggaagacgatccttccgaggatgagatgaaccagcgccagcgggtcatcttcctccttgaagaggtcaagacgtcgtttcgcaagaaacgcaaggtgtactcgaagttcgaccagtgcgcctgcgtggacaagcgggtggccggcatccagaaggagatcatggtcttcaaggacgagatcgtgacccgccttcgtgacatcaagctcgaaaagacgcttatcgaccgcatcatcgagatcgtcgaggactatgtgcgtcagatgcacaactgtcagcgcgacctctcggcctatatcctgtcggtcggcaagtcccagtccgaaatccaggagatgttcgcccagctcgacgcccgggagatcaatcccatgatcgccgccgagtcgctggggctgaccgtggaagagcttttctccttcaaggaaatgctctcggccaagatggagattctcgttcggcttcaggacaagtgctgccacaacgtccacgagctcgaagaggtgctgtggcgcatcaagcgcggcaacaacgccgcccagcgcgccaagcaggaactgatccgggccaacctgcgcctggtcgtgtccatcgccaaaaagtacaccaaccgcggtctgcagtttctcgatctcatccaggaaggcaacatcggccttatgaaggccgtggacaagttcgagtatcagcgcggctacaagttctcgacctacgccacctggtggatacggcaagccatcacccgcgccatcgcggaccaggcccgcaccatccgcatcccggtgcacatgatcgaaaccatcaacaaactcattcgcacctcgcgctatctggtccaggagctcggtcgcgacccgaccccggaagagatcgccgagcgcatggattatccgctggagaaggtcaaaaaggtcctcaagatcgccaaggagccgatttccctggaaacgcccatcggcgacgaagaggattcgagcctgggcgacttcatcgaggacaaaaaggccctggctccggccgaggaagtggtcaacaccaagcttggcgagcagatcggcaaggtgctttccgatctgaccccgcgcgaggagcaggtgctgcgcaagcgtttcgggcttggcgagaagtcggaccacacccttgaggaagtgggcaagctgttcaacgtcacccgcgagcgcatccgacagatcgaggccaaggccctgcgcaagctgcgccatccggtgcgcagccagcatctgcggtcgtactacgaaggctaagccgcgctaatcgcttctgctgctttagaaaacgagaacgccctccggtcgtatagatcggagggcgtttttttccggcggctgataagccggctgccggtcgtacctgggaacatggtattctagttgccggtgtactgccgcaaaaactgatcgagctggttggcgaacgcctcccggtcccggttggacaggggcggcgggccgccggtgaccacccccgagtcgcgcagctccgagagcagcccccgcatggccagcttgcccaggatgttgtcgcgggtgtagcgctccccgcgcgggttcagggcatgggcgtccttctccaccacctgggcagccaacggaatgtcggccgtaatgaccagatcgccgggagccacgcgttcgacgatgaccccgtccaccacgtcaaagccctggcccacccgcacggccgtgatatggggcgactcggggaagcgcagggccttgttggcgacgagcaccagggcaatcccccggcgcatggccgcccggcacaggatgtccttgatgggcgtgggcagggcgtcggcatcggcgtaaatcttcatgctgtccttacgcgtcgtgaaaaggttagacgatgacgtgccgccggatgtaggccacggcctcttccggcgtgtccaggaccgtgaacagctccaggtcctcggctgagacgaacccccgatccagaaccgtgcccttgaaccagtcaatcagcccgccccagaaggccttgcccatgaagatgatgggaaagggcttgatgcgccgggtctggatgagcaccagggcttcgctcagttcgtccagggtgccgaagcccccgggcatggcgatgtaggccatggcgtacttgatgaacatgagtttgcggatgaaaaaatagcggtaatcgctgcggatggtcaggaacttgttgggctgctgctcaaggggcagatggatatgcaagcccaccgactcgccgccgcattcgtaggcccccttattggccgcttccatgagccccggtccgccgccggtgatgaccgaatagccggcctggcacagcatgtgggcaagcttggccgtttcagcgtagagcggttcgtcggggcctatcctggccgagccgaagatggacacggccggtttcaattctccaagctgctcgaatccatcgacgatttcggccatgatcttgaaaagccgccaggattccgacatcgacagatcgttgatcaagtattggcgcgaggcggacatgggcgctcctttggctgattaccgggcagggccttttcagcggcggccgaacggggtacacggcgtcctccggcaaacggccgaccgccgtttgccggtcttgcccgcaaaggcgcttattatcaagacgcggccgcctgggcggccgcacccggaggcaccatgaaggtcaagttcctcggcgcggccggaaccgtcaccggttcctgccatcttatcgagaccgccacggcccgctttgccatcgactgcggcatgcaccagggcaacgaggtcatcgagcgccgaaacctcgacacctcggtctacaagccccgcaacatcgacttcttcctgctcacccacgcccatatcgaccattcgggactccttccgcgcatggtcaagaccggctttagcggcaagatctattgcacgccgccgaccaaagagctgctcgccatcatgctggaggacagcgcccacatccaggagatggaagccgaatgggccagccgcaaaagccgccgccatggcggccggaccgtggaagccctctacaccaaggccgacgccctggccgccgccgccttgttgacccctgtcccttacggcgagtccttctcgccggccccgggcatcaccgccgtctaccacgacgccgggcatatcctgggatcggcctttattgaattgtccctggacggcaacggcaagcgcacgcggatgctgttctccggcgacctcggccggcccgatcagctcctcgtcaacgatccggacaagccggtggagtccgactacctctttctggaaggcacctacggcgaccgcgaccacaaaaacccccaggacagccgcgaggaactggcccaggccatccgcgagagctacacccggggcggcaaggtcatcattccggcctttgccgtggaacgcacccaggaaatgcttttctgcctgcacctgctgctcaaggaaggccgcatcccggccgatctgccggtcttcgtggacagcccgctggccatcaaggccacggagatctttcgccgcaacccggcctacctcgacgccgagacccgggcctattatgatcggggcgaagacccgctgtccctgcccaatctccgcttcacccagaccaccgaccagtcgcgcgagatcaacgaactcaaaggcccggccatcgtcatcgccgccagcggcatgtgcaacgccggccgcgtcaagcaccacctgcgccacaacctgtggcgtcccgaggccggcatcgtctttgtcggcttccaggccatgggcacgcccggccgcaagatcgtggacggcgcgaaaatgatccgcatcctgggcgaggaagtggcggtcaacgccaaggtctacaccatcggcggcttttcctcccacgctggccagagccagattctcgcctggctgtcgcatttcaaggtcaaccatccccaggtgtttctggtccacggcgagcagaagtccctggagaccctggccgggctgatccgccagcgttttggggtcaaggtgcgcattccccagtaccttgaggaatacacgctcacgcccggagccgagccggtggtggccgtggacgccgaaaaggcccacccgcatatcgactgggaagtgctgttcgccgagatggaaggacggctggcccggcttcgtggcaaggccaaggatctgtccgagcgcccgtccgaggagcaggcggaactgcgccagcggattacgaccctggaccgggagatgttggagctgctctcggaattgtaggctcaaacaacggacgcggcttcgggcaggccccggggccgcgccgtccgtcgacaggggagggcggcgtggctggcgtccggtgctcgaaatccgtaaaaagcctttcgggccttggctgcttgggagcgggaagcgccccggaaggcgcggcccgtgagtcggcgggcggctggctacttgaggcggtaggtgatgcggccgcgggtgaggtcgtagggcgaaagctcgaccttgacccggtcgccgggcaggatgcggatgtagaacttgcgcattttgccggaaatgtgggccagcacttcgtgaccgttttccagctcgacgcggaacatggcgttgggcagtgcttcctgcaccacgccgtcaacctcgatggcgccttctttggccataaacagtatcctcctgacggcgcgccccatggacgcggccgaatggtcgcgttatcgtgaacggggttaggtagatggttttttcgaaaaaggcaaggggcagggaggcttgccgtccgttcttgccgcctggccgcattttggagtatagcgttgaaaaaaaggaagaaccgccgtgctgacgcgaccgcaactcgataaatacgccgatgtcctggtctgggggcttttgacttcccgcaccgaaccctacaagcccggcgacgtggtgctcgtccaatacgaactggccgccctgaaactggccgaggccgtctacgccaagctcttggagcgcggcatcagtcccgtgccgcgactggcgctcaccccggccatggaaagcgccttctacggcaaggccgacgaggcccagctcgtgttccaggcccctggacaggccgaacttcacgaaaatctccacggggccatgcatctgctcggcccggacagtctgacgcacttaagcggcgtggaccccaagcgcatcgccgccgccgccgtggcccgcaagcccctgcgcgacatcctggtgcgccgggaggaacgcggcgaattcagctggacgctgtgcctgtatcccacggccgaactggccgccaaggccgggctgtcgaaaaaggattacgccgcccaggtcgtggccgcctgctttctcaaagaccccgaccccgtggcccgctggcgggcgctgtatgaagaggtccgggagatcaaggcctggcttggcagcatcaaggccgactatctccatgtggagtcggtcggcgtggacctcaaggtgagcatcggcgagcgccgccgctggcttgggctttcaggacacaatatcccaagcttcgagatatttacttcgcccgactggcgcggcgtgtccgggcgctatttcgccgaccagccgtcgtatcgcagcggcaatctcgtctccggcgtgcgtctgaccttcaaggacgggcaggtggccgaggtttcggccgagcagggcgagcagttcgtgcgtaaacagctggccatggaccccggagcctcgcgcatcggcgaattttccctgactgatcggcgtttttcgcgcatcgacaagttcatggccaatacgctgtatgacgaaaactttggcggaccgaacggcaactgccacgtggccgtgggaagttcctattccgatacctacgacggcgacccggccagcctggatgccgccaggaaagccgaactgggcttcaacgattcggccctgcattgggacctcgtcaataccgagcccaagcgggtgcgcgcccatctggcggacggcagcgacgtgaccatctatgaagatgggcagttcacgtattgacgcgacgagcggcctgccgtaacgcggcaggggcgcgcccgcgcggcgcgcagccacacggaagggagcggggtatgcggaaactggcgatgctgacggttgtggtcctggcgcttctggccggtctggcccaggccggacccaagaccaaccccaacattcggggctgggagcggggcggggcctacgacaagctgtttgatcccaaggaagccgacgccatcaaggggcgggtggtcaagatttacgatatcgtgcctttgccgggcatggccacgggcgtggccctgcaggtcgaggacaagaaagataaaaccttggaaatcgtgcatcttggccccaaggaattcgtcgatctggcctccatcggcctcaaggaaggcgatcaggtcaaggcggccggcgcctgggccgaattcgacggccaggacgtgctcatggccgtcaaggtcaagaagggcgacgacgttcagctcaaggttcgtcgcaccaaggacggtttcccgttctggagcatgacgcccgaagagcgccagcgcgaagccggaatggacgccggggactaactttgtttttcacctggcggcgttcggcaacggcgcggccaggagatctcgggatttttctgccggcccgcgcatcggccttgcgctttacggccgcttttcgtaagaattgctatagcgacgcaatttgccgccccaggcgcggccacactataaacgggagcttgccgcatggaggaaaccctcaagaaacaggatgccgaactcctccaactcgtcacgttcagtattggcgaggaggaatttggcgtcgatatcctcagcgtgcaggagatcatccgcatgatggatatcaccaaggtcccgcgcgcccccgagttcgtcgagggcgtcatcaacctgcggggcaaggtcatacccattattgatcttcggcggcgctttggcttgaccacacgggaccacgacaagcatacccgcatcatcgtcattgagatcaacaacatgattgtcgggtttgtggtcgattccgtctccgaggtgctgcgcatacccgccagcacggtggagccgccgccacccgtcgtttcgggcctggagtccgaatacatcagcggcgtgggcaagctcgaggatcggctgctcatcctgctcgacctcaacaagctgctttccggcgaagaacgggacatgctcggttccttctaaagctggctcgccgcgccaagtccggtcggaccggcctgctgggccgtccccgacggtcgggtcctggacggctcggcgcaatctgttacgcggttacggccgccgtcactttcgtggcggcggccatcccgtatttttttcacgaggaccatcttgtcccgcacagcttcgcccctcgccgaactcctcgccgccagcgattccgcctcggtctataaaagcgggccggccaccctggcctatctggccgccgccgccctggcccgggggcaatccgccgtggtcgtggccccgggcgttcacgaactctcgcgcatcgccgcgctgctggacatgctggccccgccctcgcccgggaccctgtggggcgcgtcctacgccatgctgccctcctacgccccgggccggccaagcggcgcgttctgggcccggcgcatggcctttctggcctttgccgccatgggcaaaggcccacgcgtgctgctggtcaccgccgacaacctgttgcccaagtggccgccgccgcgcgccctggagggcaacattttaaacgtcgccgtgggcgaggaactgccacgggacctcatcgccgaacaggccgtgctgtggggttacaagcgctcgcccatggtggccaatcccggcgaattcgcccttcgcggcgacatcctcgacatcttcccgccgggctatgaaagtcccttgcgtctggaatttttcggcgatgtcctggaagccgtacgccgtttcgacgccggcacccagcgctccctggccgaactccccgaagcctccctcatcccggccgccccggctgtgctgtccgaaaccttcatggatgaggccagaacgctgtgggagaccatcgccggcacgggggaactgcaccgggccgccaagcagcgcctggaaaacgccttgcaggtccgcgacggcggcatctggcccgggcttttttacgaaaagccggtggagctttcggcctggtttcccgaaggcgcggcctatttcgtgtgcgaccccaccaaggtcaaggagcgcctggaagaagccgaacacgcctggcggcgttttttcgaggccgaaaccaaggagcttggccatccctggccgaactcccgggtgttgtggcccgaaaacatggcccgcaaatccctggtggctggccggcgcattctcttcgaggatctggtcatgggccggggccgccatggcccggatctgccggaaaaggtcctggaacgctttggtgaccttttctggaagcccggctcggacaagcgcccctggaccaccctggtcgccgccctcaaggaatggaacggccacggccagaccatcctgtccttccacggcgagcggtcgcgcaagaaattcctgcaaatgatcgagccggaagggctggtctttcgcaccggctatagcccggacgagaccgggcttttcgcgctgctctcgccgctgcgacacggcatggagctttcgtggcgcgacacccgcatcctggccgaggacatcctgcaccccgagtcggccaagggcggttccgagcgggccgacaaggacttcaagggcctggcctcctttgacgacatccgccccggcgatctggtcgtccaccgcgattacggcgtggccaccttcgagggcctcacccgcatgaccgtggacgccaccggcggcgattatctgctgctggtctttgccgacgaggacaagctctatctgcccgccgaccgcctgggcctgttgcaacgctacaaaggacccgaaggcatttcgccgccgctggaccgactgggcggggcgcgctggaagtccgtgcgcgagcgggccaaaaaggccgtggaacgcatcgccgccgatctggtcgagatgtacgcctaccggcaagtggccaaaggctatgcctacggccccaccaacgaactgtacctggaattcgaggccaccttcggcttcgaggagacgccggaccaggaacgggccattggcgaggtcctggccgacatggagcggcccgagcccatggaccggctggtgtgcggcgacgtgggcttcggcaagaccgaggtggccctgcgggccgccttccgggcggtgcttgacggcaagcaggtggccatgctgtgcccgaccacggtcctggccgagcagcactaccagaatttcgccgcccggctggaaggctttccggtgcgggtggagatgctctcgcgctttgtctcgcccaagcggcgcaaggtggtgctggaagccgtgtcgcgcggcgaggtggacatcctggtcggcacccaccgcatcctgtcttccgacgtggccatccccaacatcggcctgctcattctcgatgaggagcagcgctttggcgtcaagcacaaggagcggctcaaggcgtttaagaaaaacatcgacgccctgacgctgacggccacgcccattccgcgcaccctgcaactgtccctttccggtgtgcggggcctgtcggtcatcgagacgccgccgccggaccgcaagaccgtggacactgctctggtcgagcgcgacgagggctttttgcgcgaggtgctgcgccgcgaactcgaccgccagggccaggtgttctgggtacacaaccgggtccagggcctggaggacgtgaccgcctacgtcaagaccttggctcccggagccaaggtggccatggcccacggccagatgtcggaaaccgccctggaggaagccatgcacggcttttggcacggcgagaccgacattctcgtgtgcacctccatcatcgaatctggcctggattttccccgggccaacaccttgattgtggacaacgcccacatgttcggcctgggccagctctaccagctgcgcggccgggtggggcgctcgccgcgccaggcctatgcctacttcgtcgtacccagcatcgagaaggtgccggagctggcccgcaagcgcctgcgcgtcatcctggacatggactacctgggggccggcttccaggtggccatggaagacctgcggctgcgcggggccggcaacatcctgggcgaggcccagtccggccatatcgcccgaatcggcctggacatgttcctggaaatgctggccgaggaagtgcggcggctcaagggcgagccgatcaaggagcgcatcgagaccgaactcaccctgggcatcgccgcccgcatccccgagcgctacgtgcccgaggcttccgaccgcctgcgcctgtataaggccttgtccacggccaagaccgaagagcgcctggccgagatcgccgccgagatgcgcgaccgttttggctcgcctccggccgaggtggacaatttccggtccgttttggccttcaagcaggtgctcggacgccttggcgcgaccaaggccgagatcacgcccacgcgtctgactgtggccttcgaggccgagggcgcgtccgtttccacggagcggctcgtcgccttcgtggccgcccatccggccgtgcgcctgctgccgccgggcaagatcgtgctgcccctggacgccgccttgccgctgcccgaggccattgccgtctgggccggcgaactggccggcttgggcgaaggggagggggcgtgacaaggcggcttggccggggctggcgcttggcggccgccctggtgctgtccttttgcctttggggctgcggccgcgacacggccgacgagccgggcgtggtggccgtggtcaacggttcgcccatccgactggccgagctggaaatgcgaaacgatgtcagccggatcagccaaccagctgttgacaatccggcggtcgaggacctgcgcgccggccttggagcggctctggccgacgcggtcgtggcccggctggtaggccaggaactcaagcgtttgggccaggctcccacgcctgaggagttggaaaaggccgaggcggccgtgcgggccgattatccgggcgaagctttcgagcgcatgttgcttgaagagcacattgatctggcccgttggcgggagatgctggccgaccgactggctctggaaaaatttcgccaggacgtgctgttgcccggacagcgggtgggcgtgtccgaggcggctgcctattacaaggaacaccaggccgcctttgcccggccggccatggtgacgcttcgcgtggtgtccggccgggacgccgaagcggtcaaggcggccctggctgcggcgcgcaagtccggccagggcgaggcctcgcttggccgggaggcggtgatgcccgaagccgggctgccccaggcctggcgcgacgccctgcgcggcaaaaagcccggcgaagcgacccctcccctggccatgggccgcgaacatgtcgccctggtgctggtggaacgcacgcccgccgccatgcccgatccggccaaggcctacgcccgggtcgaggcccggctcactgaggaaaagctgaccaaggcctttgacgcctggctggccaaggcgctcggtcaggcgaccatccgggtcaatgcccggttgctgccggccgcagccatgctggcccagatcgacactaaggacggcgacgccgagcttgtcgccgccaaggtccaggaagaggccagcgtctatgtggccggcgcggcccgccgtgccctggcggaccgccagccgacggccgcctcgcctgcttcgccggatgagccgccggcctcccctccctcggccccgcccgcagacgagacgatcaccccggcccttgcgcccgcgctgccggtcccggaacagggggcgcgcccggtcgcgccgccgcccgcgtccacgccgtcttccggtccggccgaaccggcggttcccggcgagagcggcgcggcggcgtccaggggcacggcctcagcgccagctcccccgcccgtttcggacgaggctcgggtgcgcgaaggatcggcagcccggcccgtggccaatggggccaagccggctcaggtctccggttccgggcctgacagcaacgccgccggacgtgacgaggcttctgcggccttccccgaggccacgcccgcccagccgacgccggcagataggaccggttcgcaacccgaggcactccagtctggggctgccgcgactgtggccggcaatgccgtcggccaacgggacgcagcggcctcaggacagccgcccggtccgatcgcaggccctggcgaggtcgaattcaccgctgtcaaggcgagttggattctctacacggcggacgacggccgggaagagcgggtctatctcaagcccggcaagccgcaccgagtggcctattcccgacggctcaccgttcggcttggcagccccagcgaagtggcctaccgtgccggcgcacgggccgaaaccgtcgaggtcggcaaaaaggaaagccgggtgctggaatttccttaggcccgcccaacggcggacgggcatgattgcctggggttgcaaaaacgcgtatacgccccggatgcgtggctacgacgctctgggaggagatcggcgtggtcaggcgacgcttccggggcatcgccgggcgggctcggcgagcccattgcagacggctgccttagccccattcatggaggatactttgccgcaaatcgcgaaattttttggtgtgttggcgcttctggcgagtctggctaccccggccggagccgccgaactggtggatcgagttgtggctgtcgtcaacggcaaactcatcaccctgtttgacgtcaatacccgcgtggcggacatggtcaagcagacccagggcgtggcgcttaagcccgatgatccccgcctcgacgatctgcggcggcaagtgctggaaagcatgatcaccgatatgctcatcgaaagcgaggccaacaagctcaaggtgacggtttccgatacggaaatcgattcgcaaatcgaagagatcaagaaaaagaacaacctttcccagcagcagttcgtcacggaactggccaaggaaggcctgacgctcaagcagttccgcgacaagatgcgcctggacagcatcaagaagcgtctgctcggtttcatggtgcatcgcaaggtgctcgtcactgacgacgagatccgcgactactacgagaagaacaagggcagcttgtccgccgccaagtccgtgctcggccccaaggtttccggagggctcgggtttatcatggtgcccaacaagaagcaggccgaggaattgcgcgacaggatcaattccggttccatgtccttcgctgatgcggccaagaaattttccatcgggcctggccgcgaccagggcggcgatctgggcgacgtgcagatcaaggatctggctccgcctctgcgtagcgcgctgaccgccgtgcctcccggacaggtcagcgaaccggtccttctcgacggcaaagccgtgctgctcgtccagcggacggcctcggctccggcggaaaagccagctgccccggcggcagcggccgggtcgaatccgtcctatgaggcggccaaggaacagattcaggaactgctctataagcagaaattcgacaaactcttccaggaatacatcgacaatctgcggtccaaagccgtcgttgaagtcaagctttagggcttgcgatggtccgccgggcgtcctcccgctcccggcgttacggactcagaggagttttttgtatggatttgcgtgagatagggacgatgctacgcgaggagcgggagcggcagggactctccctcgacacggtgtcggacaagaccaagatatcacgatcctgtctggcggccattgaggagggtaacgacagcctgttgccccatccggtgtatgccaagggattcataaagaattacgcgcgattgctcggggtggaccatgcggagttcgcctcccgtctctcgaccgtgtatcaggtcgaagagccgacggcgtttcgcgacatctcgcttgttaccgaccttcccgacgatgattgcggctgtagcgtgtcttcgtccgctccccgcccgccggtaacgctctggctcgccggagccggggccgttctcgtcgtcctggccctgggatggtatcttttttcgcatgtgttttccggctccggcgcatccggcgacgaggtcaagccgtcggaaacggccaccgttgctccgagcaagcctcttgctgcgcccgcccccgagccaacgccgcctgtggcggctcccacgccggttcagcccgcgccgaccgtgccgccggtcgtgacgcccaccgtgccgccggccgtgacgccggctcccgccgagacgctcaagccccagtcggaaaccgccaaaacaggcgcgcccacagccgacgacaaggccacccaggacattgccgtcagcggtccggccggttcggctccggccgtgcccgccgccccggaggccacgcccgcagccccggccgccccggtcgcgccaacagccaagaactttaccgtgggcgaaaccggaccccatgtcgtgaccatcgccgccaacgagcgctgctggctccaggccggagccgacggcggggccatgcacgaaaccatgctcgaaaagggcgacaccttcaccggccgattcgccgacaacatgctcgtgcgactgggcaacgccggtgcggtggaaatccatttcgacaacaagctctatcccctccaggccggcaaggggtcggtcaagacgctcaagtttgtggccaagaaaaccgaccagccgacctcggccaatggtcagggacagccttcggccgtgccccaaacggctgcggcgccgacggcccagccggctgcgtcgctgcccgtcgcttccccggccgtcgcccccacgcccggcccggccgccgagaacgcctccggagccaaggaagtcgagatctacggccaggacggcagctgggtcatcgtcagcccggacaaggggccgtccaaggaaatctacgtgaaaaagggccagcgcatcaccgtgccctttggcgagaagattgaaatcaagctcggcaacccgagcagcgtggtgtttcgctacaacggccaggaaacgccggtgaccaccgagaagggggccatcaagaccatccggttcccgcagtaagggagccaatggtcaggcgcgtccgaccttggcggcaggcaatggaaagcggtctgggttcgtccgagaacacaggcttacgggcgcttgtcagggcgctgtggacgcttgtcggcgtttgcagcgccttgaccgcgccgtgacggtcggaccgggacggcatggagtatagcgatcaggccctcatactggccgtcaaacggttccgggagatcgacgcctgggtgcgcttgctctcgccgacgcggggggtctatacggcctttgccttcggggggctcaaaagccgccgccgtttcctgggttgccttgatccgctcaaccacgtccagttcaaggtgcgtcgctcgggctatcgcggctaccattgtctggccgagggcaagctgcttgatgccccaaggcagttgcgaagccatccccaacgcctgggcatggctgttaactgcttgaaatttttcgaggccgccccggtcgctccgggaagcttcgcccaggcgtacggcctgatgcgcgcgatgctctcgaccctggacgcggccgacgagccgtcgccgctttttccgctcctttttcgggcgcggatgacgtttttgcacggcatgttgccggcctgcggccagtgcgccgtctgcggccagcccctgggccatgacggagcggtgtgccatgtggaggaggggcgggtggcctgccccgactgccgcgcggccgcctcgggtggcgtgcatgcccgccttggcggtgaggcgctggcgcttctggcttcggccgtggagcaggggccggagcagtgggccgcctgccggccccatccggccgccggccgggagttttcccgggccgtggatctcctggtgcgctaccacatggggctggcctgggagcagggtggattcgtgcgagcctgatttggggggcgcgcggcgtatttcgtaggcccggtcggactgtcgttttgcctcggtcctgctggaccggcccaagcggccggtgaacggattttatttggccgggaggcttttcgcggggcgcggcgcgtgcgccggcccgccccgtcgccgccgctgcccggccggcggcgaaaccttgaaatcggagcgagcatgtactttcaggatgtcattttgacgctgcaaaacttctgggccaagtccggttgcctggtggtccagccctacgacagcgaggtcggggccggcaccttcaatccgcatacgtttttccgggtcatcggtcccgaaccctggaacgtcgcctacgtgcagccctcgcgccgccccaccgacggccgctacggcgaaaatcccaaccgcctgcagcactattaccagttccaggtgatcctcaagccctcgccggacaacatccaggatctctatttgcaaagcctggccgccctggggctttccgcctcggaccacgacgtgcgtttcgttgaggacgactgggaatcccccacccttggggcctggggcctgggctgggaagtctggctcgacggcatggaagccacccagttcacctacttccagcaggtgggcggcatcgacctgtcgccggtttcggtggagatcacctatggccttgagcgcatcaccatgtacctgcagcaaaaggactcggtctacgacctggattggaacgaccaggtcacctacggccaagtgcaccagcgcggcgaatacgaacattcgcgctacaatttcgaggaatccgacgccgccatgctcctggcccatttcaatgcctgcgagaaggagtgcaaacggctgtgcgaactgggcctgccctggccggcctatgactactgcctcaagtgttcccacgccttcaacatgctcgaagcccggggagccatctccatcaccgagcgcaccggctacatcggccgggtgcgggccctggcctcggcgctggcccggctctacgctgcccagcgcaaggaactcgactatcccctgctcaacaaaggctaaaggaaccacgccatgtcccattttctgttcgagatcggattcgaggagatgccggcccggttcctgcccgggctcgtcgacgaggtgaaaaagctctttgccgaagggctgacccaggccaaggtcgactgcgggaccatcgccgcctttgccacgccccgccgtctggtcgtcagcgtgcccgacctggccgccgccgcccgccgggaagaggaagtcgtcagcggcccgcccgagaaagtgggcttcgacgccgccggcgcgcccaccaaggccgccgagggctttgccaagggccagggcctggacgtgtccgccgtcttcgtcatggacacgcccaagggccgctatctggccctgcgcaagaccaccggcggcgaggccgccattgaactcctgccggccctgtgcctggaggcggtcaaaaagctctccttccccaagcgcatgcgctggggcagccgcgagttcgcctttggccggccggtgcactggtttttggctcttctcgacgacgctgtggtgccgttccagttcgacgacatcacctccggccgcgctacctacggccagcgcatcatgggccccggccccttcgaggtgcccacggcggccgcctatttcgacatcatccgcgacaagggcaaggtcgttctcgacgcccgggaacgcgaaggcatcgtgcgctcccaggccgaagccctggccaaggaagccggcggcacggccgtcatcaatccggcccttttggctgaggtcacgggcctcaccgaacatccggtggtgctgcttggccgtttcgaccccaaattcctcgacgtgccccgcgaagtgctcatcaccagcatggagagccatcaaaagagctttgccgtggaagacggcaagggcgggcttctgcccgttttcctgacgaccctgggccttgtgccgggcaatgtggaactcgtgcgccggggctggcagcgggtgctgaccgcccgcctggaagacgcccggtttttctgggaggccgatctttcggccagcctggaaacctggcagaaaaagctggaaaacgtggtcttcctggccggccttggctccatgcgcgacaagggcaagcggttggaacggctgtgcgggcttatcgccgaacaggccggcaagcccgagatcatgctggaagcctcccaggccggcggactggccaaagttgatctcgtttcggatatggtgggcgagttcgccgaactccaagggatcatgggcggcatttacagccgtcgcaagggccagtccaagacggcctcccgggccgtggccgagcagtatctgccggccggaccggacagccccgtgccggcgaccctggccggcgccatcctgtccatcgccgacaaggccgacactctggccggctgcttcggcctggacatggccccgaccggcgcggccgacccctacgccctgcgccgggcggccctgggcatctgccgcgtcgtcatcgagcacggcttgcgcctggacctcatggaactgctccagggagccatcgacggctacggcgaggtgaagttcaaggtggaccgcacccacgtcctggccaagctcctcgacttcttcggccagcgcctcaaggcctacttcaccggccagggctacgacaccttggtggtggaagcggccctgggcgcgtcctacaccgacatcgccgcgctgtcggcccgtctgtccgccctggccggattcgccgccaagccggactttgaccaggccgtgctgaccttcaagcgggccgccaacatcattcgcaagcagggcgtgggagccggcgtgccgctgaccggcgcggtcaaggcggcgctcctggaagagcaggccgagaaggatctggcggcggtgtgccaggacgtgttcccgcgcttcgatgcgctcttcgatgccggcgactacggggcggtgctggagctgctttacgagctgcggccgtcggtggacgccttcttcgacaacgtcatggtcatgtgcgacgacatggatatgcggcttaaccgcctcaatctgctcaagtcgctggttgaccgtctgggccgggtggcggatttcgccgccctacaagtgtaatattcgcataaattgcttgacagggttggcgcattgggctagctaatcctgcttcagcgaacacttcacggaggaacgatccttggccaaccataaatccgccatcaaacggcatcgtcaaaaccttttggcccgggctcgcaaccgggcggtcaagacccgcgtgcgtaacgtcatcaaggccgtgcgcgccgccctgatcggcggggacgccgctgccgccgaaaccgccctgctgaccgccaccaaggtgctcgacaaggccgccaccaaaaagatcattcactggaagaccgccgcccgcaacatctcgcggctgtccactgccgtcaacaaggccaaatcggcctagtcttccggtttactggtgtttttccaaggcccgccgcgaggtttcgcggtgggcttttggcgtttgcagcatggcgactgcggctgtttggctgggcggagtgggacggtcctgaggcttttgccggggtgaatttcggctggcgcttgcgccttggccggggcagagtcgggcgacgcacccgaaaggagcagggcatgggcaaatggtttggaacgatggtgttggcgatgctgtttacagcgctcggcggggctgttgcctttgccgggccgcccgtttccgctatttcggccagttacgacgcggacaagccggcggccggccggccccatccggccgcgaccgaggcggaaaaagccctggacaagctgctgcggctttcggagaagcgcgtcgggctggtggccgcgctgcttggccgacctggcggcggcaagggcgaggccgccttggcgcgcgagctgaccaccgtccggctacgccatgatctgtccgagctggaacgcaaagccgttcgcgacaactgcaaagggcgctatattcctggtgaactctgcggcctggattacaatccgctcacctgcgcccaggacgaatccgacgcgccctatagctaccgcaccacggccgcgactgccgaccggtcggacatcacctattcctggccgggctcggccgccccttcggcgagctttgtcatggtccgggaggcaggggtctggaagctcgacgccgcgcggtgtctgccgtgaccggggagaatgggcgagcgaggcggctgctggtcgcggccgacatttacggcatcaccccggcgcttcgcgccttggcggccgatctcggcggcgaggccgagttcctttctccttgggaaggcgagggcagtccctttgccacggaacaggactcccacgccgcgttcgttgccgggcccgggcttgaggcctatgccgagcggattgccatggcgtcggccggggagccggttatgctggtgggatttagcgtcggggccacggcggcctggcttttcgccgccgggcagcattgtcatccagactgccggctcgtgctgttctacggctcgcgcatccgccattatctggatttgcgcccgcgttgccgggtggaggccattttcgccgaacacgaagcggcttttgatccgcaggccgtggcggcggccatcgcctcggagacggtgcggaccgaggtcgtgccggactcggcccatggatttatgaacgcgctttcgccgggctatgacgcggcgttggccgggcggcagcttgccgcgctacgcacggcaacggcagaagtcctgtcactgtaaaaagccgtcgtcacggtacgggagcttggtcatgaaacaaggcaggatgaaagcccgggtccggtactgggtggttgtgctgctgtgggcgacgttgctgctggcgaacacgagcgccccgtgtctggccgcgcccagccacacgattgacgcgcgttttgatcccgccgccaggaccctggccgtcacggcgacattgatccttccaggcgggcagggcgggcacgtcgtcacccttgcgcccacggccagggacttgcgtcttgccgccggcaacgtcgccattgccttccagcgtgccaaggacactgtccgcttccatacgccgccgggcacgtcgtcgatccggctggactatgtcctgccgctggacgcgccgccggaggaactgccggtctccatggacaatcccggcgcgctggcctcggacgcggtcagcggcgctgactgggccatgctcatgccggcaagcctctggcatccgctgcttgcgggtagggccaacgcctaccatctgcgcttgagcgccccaagcggcatcaaagccgtcacccagggaacgcttggacgaattgacgatcaggatgggcaaaccgtctccacctgggacattgccaagcccgtgggccgtctgggcctttgcctggctccctacacgctttccgaggccagggacgcgccggccctggtccagacctttctgctggcccagtcgaaccgattggctgcgacctatctggccgcttcggccaagtatttgcgcttttacaccgatctgcacggaccctacgcctttacgaagttcgcggtggcggagaatccgctgcccacgggctacggcctgccgtcctacacgttgctcggctcccaggtcattgccttgcccttcattccggccaccagcctgcgccacgagatcgcccattcgtggtggggcaacggcgtgctggtggacgacgccgggggcaactggtgcgaggggctgaccacctatgtggccgattacctggccaaggaggaggagtcgccccaggcggcccgggagtatcgcctgaaaaccttgcgcgcctttgccgccttggccggccagggccaggacatgccgctggaccgctttggcgggcgtttttcgccggccagtcaggcggttggttacggcaaggcgatgtacgtctttcacatgctgcgtggcttcgtcggcgaggccgccttttggcagggattgcgccagctctatgccgcgcgtcttttcaagcccacctcctgggaagacatccgccgcgtctatgccgggctgcccgggttcgacgcggcccgcagccggcgctttttccgccaatggctgacgcgcccgggcggcccgaccccgcggctggagcgggtcgcggccaaggccaatccggccggcggctatgacgtgacggttgttgtcggccagggcgggcaaccgtatctgctgcgtctgactcttgctgtcgaaaccgaggccggccaaacggccacgaccttcgtcatggacagccggcggcatacggcgtcgctgaccgtgccggccaggccgctgcgggcggtcctggaccccggggccgactgtttccggctactggacgcggccgaatccccgcccacggtcaacgcggtcaaggccagccgggcgctgacggtgctggtggccgacgacgcgcccgagagtctccaggccgccgtgccccggctgttggccggcctgggccaggaaggcgcgcggttgatccgggaatccgccctggatgggccagccgtcgccgcccttgggcagggcgacgtgctggtcgtgggtcggccccgggtggccgtcgagggcatggtcgacgccctggccttgtcgccggagagcgacacggcgtttgccgtggtcaagcgggggcaagggatcgcggcggcattcacggcccggcccgaagcggcggccaaggatgtggaagcggcggcgggcaaggtcacccactatggttcgtttgggattgtgggattcaaggaaggcaagaacgtgcggaaaagcacgccggaaccagcggattcgccgttaatcaaaacattttgacgtctccatgtgggggccgggggggcggtcggcccccggccgccggaggcatccgcctttgcgctaaggcgtgatccgcaaccgcgccttcccgtcctccatctccgccactcgcccgatgaccgccgccagatcgccggccgcttccaacatcgcctgcgccgccgtgactttttccgccggcacggccagcacaagtccgccggaggtctgggcgtcgaacaccagatcgcagcggatggggtccatgcccgaagcccacgacacgtctccggagcaatgccgtttgttggcgaagctgccggctggcaacatgccgtagccggccagttccacggcctcgggcaaaaacgggatggacgccagcgacagctctaccgcgaccttggaggccgtcgccatctccagcacatggccgcccaggccaaagccggtgacgtcggtggctgcccgcaggcccagttcccggatgacccggcctccagcggcattcaagcgaccagcccactttcccagaagcgcttccagggccgccttgtcgccgaaatcgcccttaagcgccgtggccaggacgccggtccccagcggtttggtgagcaccagcacgtcgccgggcacaagcccggtgttcgaggcaaaggcgtcggcctcgaccagcccggagacggacagcccgtacttgatctcgtcgtcctcgacgctgtgtcccccggccggcacggctccggcttccagcaccgcttccagcccgccgcgcaggatctcgcccaggatggccgtgtccatggtcttggccggaaaacacacgatgttcatggcggccagcggtaccccacccatggcgtagacgtcggacagggcattgaccgccgcgatgcggccgaacaaaaacgggtcgttgacgatgggcgtgaagaaatccaccgtctgcaccagcccccggccgtcgggaagccgcacaatagcagcgtcctcgttgactccctggccggtgagcagacgcggatcggatatgtggggaagcccccgcaagacggccgccaggtcccctggggcgatcttggccgctcagccggcggctttgacggtcttgaccagttcgatgctcatggggtctccgtgtcgatggcctgggaaagatcatgcgccagggcctcggcgtcaaggccgtaccgggcgcaaagcacaggcagggtttcgaaaagggcctcgcacaggatgcagcagccagccgaagcgtcatagcgccgaaatacgccctccgtagccggatgggtggctaccagatcaagaacggtggtcgtggccggatcaaagctcacggtgtggcctcggctccgctttgcacggcccacatgccggcgtagacgccgcccgaggcaagaagcgcctcgtggtcgccgcgctccaccacgcagccgtcgaccacgaccaaaatgaggtcgcactggcgcacggtggacaggcgatgggccacggccagggtaaggcggccctgccgcaaggcgtggaggttttgctggatgagcgcctcggtgcgggtgtccacggccgaagtggcctcgtcgagaagcaggatggccggatcgcgcaggatggcccgggccagggacacgcgctggcgttcgccgccggaaagcttcatgccgcgctcgccgatgaccgtgtcgtagccgtcgggcaggttcatgatgcgctcgtcgatgccggccatggcggcggcccggcgcacggcggccagatcggcggccggatcgccaagcaggatgttttccgccgccgtgccgtgaaacaggaacgcgtcctgggacacgtagccaagccggccgcgatagctggccagggtcaggccggacaggggcgcgccgttgacggtgatctggccgctggtcggttcgtagtagcgcagcagcagcttgaccagggtggatttgccggccccggtggggccgaccacgcccaccgactggccaaggccgacggcaaagctcacgccgtgaatgaccggctcgcggccgggataggcgaagcggacgttgtcgaagcggatctcctcggggcgcgccgtcaagggcacggcgtccgaccggtcggccacccggggttcggtagccaaaagctcggcgatgcgcgcggcggcggcttccgaacgctggatttggttgatgagcatgccgaagacaaaaagcggcagcaccagccgggcggcgaacagcgtaaaggtggtgtagtcgccgacggtcgggccggaacccgaggccaccagccagccgccgccggcaaagaccgccgcgaaggacacgccggccacggcgtaaagggccggaaggaacttggcccgctcaccctcggcggccacggcctcgtcgcggtaggcggccgaacgggcggccacggcggcatggagccggtcctcggcggtgtaggcctggatgacgcccatgccggcgatgttgttttcgagcatcccggcgatggctccgaccgccttgcgggcggcccggtagcgcggctgcacccgggtgacgaaccggcgcacggcgaagacggccaggggcaggggcgcgaaaaggagcaaggccagccgccattccaggaagaagaggtagccgtagatgcccacaaaggtgaccacgacccggatgatggaggtgctggcgtcggtgagaaagctctccagggtgtccacgtcgccgaccaccacggacatgatgtcgccggtctgcctatcctcgaaataggccgggtccagggtctggagccggccgtagagggccaggcgcaggtcgtggcgcaccttctgggcgatggcggccagggcgtagtccgagccgctttggaagatggccaggaaaataaaagccagcagcacggccaggccgtagagggcgtaggtttgggcgtcggttatgcccgaggtggcggcgtcgatgaccttgccggccagggccagggggagcaggtcgcaggcccgggccaggacgttgaggccaagtcccaggcccagagcggcgcggtagggggcgaggaagcggtagagcgtccagacatggcggccgaaaaaggggcttttgccctggagggaggtggttgtcgtcatacggcaagcagcagggcggcgtaggccacggcccccaggccaaaggccggggcgttgccggaaccgtccagggggagttcgtccttcatggtgttcatgaccacgccgccggccagaaaagcaaagagcagggccagcacggcttcgtggacatggacaagcgcgcccaggccccagccggccagcaccgcgccggccaggaccttgcggcccagatggcggtagctgtcggtgaagtggcggcgcaggccatagtcgttggcggccatgtgcagggccatggccatggcgtaggtcaccaggctcaaggggccgggcacgacccggttgaccagcagatagccgatcagaaaattgtagagagcaaaggacgtgagatgcaggcggaaaacgccctgggacggccctaggcgtgggccgtcgcggccgccacgggccaggatcgccgcccgctccagggagtagaagacgagcaggccggccagggcgatgagaaagacgtggcggtccaggagccccacccaggcccagccggtccgtgcgacggtttcctggccggcgcagagatccggaaacacatggacaaagacgtaggccacggccgcgccgccggccgccgaaagccaggggcttcgcggcgcggacaggataggcgaaagcaggcgcacgtaaagatggagcagggccagcgtcaaggcggcggccaggcttgcccagatcatgccgccccgtcctgccgggcggcggcggcggcccggcgcagcaggccttcctcgtcgcgccaggcgtccttgtcggcgtccttgaccagccggctggcccgggaaagctcgtcagcggaaagcgcgatgcccagttccgtgtagcgcagggccagggcggccttgccggacaggggcgacagcggcagccggatgccttcggccccgaccagttccggccgaaagggcagataggtgtccgggtgcttgagcaggccgtcctgatgcaccccggcggcggtggcaaagacgttggccccggtcacggccttgtttggcggcaaggtgaagccggcgcgctgggccaccagccggcacagggccgtgagcctggtcgtgtccacgtttatcgcgcggcggtactggccgggatgcagcgtcagggccatgaccgtctcttccagggcggcgttgccggcccgttcgccgatgccgcccacggtcaggtggacgatatcggctccggcggcgatggcggccagggtgttggctgtggcaaggccaagatcattgtggaaatgcgcccgcaccttgactccgcgcggctgggccaggcggacgagcatggcgatgcggcggcgcgcggtttcgggcgtcagcacgcccacggtgtcgggaaagccgatggccgtggccccggcgtccatggcggcggtataggcctcgcgcaaaaacgccggttcggtgcggctgccgtcctcgcagccaaaggtgactcgggcaaaacgctgacgggcgtaggccacggacgaggcgatcatggccagacactgggccttggtcttgccgagcttgtggcggcggtgcagggggctagtggccagaaagacgccgaccccgcgccgctcggccggcgcgtcgcctagggcttgccaggcggcgtcgacgtcggcgtcaacggcccggcaaagggccatgatgagcgggcgtgccgtggcggcggccacctgccgtacggcctcgatttcgccagccccgccggccggaaaaccggcctcgatgacgtccaccccggccgcttccagggcctgggcgatggcgaccttgtcgttgatggaaaaatgcacgccgggcatctgcgcgccgtcgcgcagggtggtgtcggagatgatgaggggagagagggaaaccgtggcggccatacgcttggacatgcgcccttttgcgccgtttttccgccaaaagcaacgtcccgacaaccgtcacgcctggagcggaatttaggggacgtcacgacggtattgtcaaatcgtgccggccctgggacttgggcatggaacgatttgacgcaggacagggcacaggatagcttttccaaagtccgcctttcccggggacgataccaatgcttgacggaggggaacatggcgacaatcggcgtactgctgtccggttgcggcgtcctggacggctcggagatccacgaggccaccctgaccctgctctatttgcacaaggccggagccaaggtcgtgtgtctggctccggaaatgactgtcgaggccatggaccatggggccaaaaagcccatgggcgagaagcgcaatgttcgcgtcgaggccgcccgcatcgcccgggggccggttgtcgacgcagccgaggtgggcgtggccgacctggacgcgcttattttgccgggcggctttggcgcggcgaaaaatctgtgcgacttcgcggataagggcggcaaaggcactgtgttgccgtcggtcgcggcgctcatcaaggccatgcatgcggccaaaaagcccattggcgccatctgcatcgccccggccgtgctggccctggcgttgggcgagcaccatccccggctgaccatcggcaacgatgccggcacggcccaagccgtcggggcggccggcggcgtccatgtggcttgcccggtggacggtatcgtggtggacgagaccaaccggctggtgacgaccccggcctacatgctcgggccgggcatcgccgacatcgcccttggtattgaaaaactggttgccgccgtgctggaaatggcggagaaccgccagcccctcgacctgtagggggcttggtggggtccagaggattgggcggcgtttgggccgctgcaagcgtttctgttttggcgcaatgagtggtgcatgaccgttttacaagggtacaaatcagcccccctcggggacggcgtccagggacgggcgcggcggcggctttttatcaatgccgatgatttcggcctcaccgacggcgtgacggccggcatcgccgaggccttggctgccggcgtggtgggcggaaccacggccatggtttgcccggatggagccgtggagcgtattcggcgctggggtcaggcgtttgccggccgggtagggctgcatctccagcttaccggcagcgcgccctgcctgccgcccggggatatcccgaccctggttggttccgacggccggtttccgcgcaaaaaggtggccgtggtggacgtcaaccccgaagaagtccgacgggaatggcgggcgcagtaccagcgcttcctcgaaacccgactcgtacccagccacctcgacgcccaccatcacatccacaagcggcccgaagttttcggggtgttcgtggagttggcccgggagtggggcttgccggcccgggcgctgtccgacgacatgcgccaggccatggacgcggcgggcgtggcccatgccgacgtgtgcgtcacgcggttttttggcgaggacttgaccacggccaagctcctgtccctggtggacgcggcctttgccgcccttggcggcgagggcgtggtggaaatcatgtgccaccccggcaaaagcgacgccgccctggctgccatcagcgtctacgccgacgcccgtgaggaagagctggccgtcctggccgcgcccggattggccaaggccctggccggccttggcgtggcggtcatcggcccggatggattggccgcgccggtggcctgacgcccacggtttccggcgcaaacgcccaagacaaggaacacgccatgccgcaaaaactgctgttgtccatgcgcaagttcgtggccccggagtttgtattcggtcgcggcggactggccctggccggacgacaagcggccgggcttggggtgcgccgggcgcttgtggtggccgatcccggacttttcccgtttggctggccccagcaggtcgaggagagtctggcccaggccggcgtggccacggtcctttttagcgacctgagcagcaacccgcgtgaccacgaggtcatggacggagcggccgtttttgccgaaaccggctgcgacgccattgtggccgtgggcggcggctcggccatggactgcggcaaggccatcggcatcgtttcggccaacaagcgccatgtgctcgaattcgagggcatcgataacgtcgagcgccccggcccgccgcttctgtgcgtgccgaccacggccggcaccggagccgaggtgtcccagttcgccatcatcaccgacacccagaaccgccgcaaggtggtcatcgccagcaagacgctcattcccgacgcggcgctcattgatcccgacgtcaccgtgaccatgccgccggacctgaccgcccacaccggcctcgacgccttgacccacgccgtggaggcctacgtgtcgagcgccagcggcccggtcaccgatcttttcgccctggaggcggcccgactggtcgccgccgccctgccagtcgccctggccgaccccggcgacattgaagcccgaggttccatgcttctggccagcctttacgccggtctggccttttccaacgccatcctcggcgcggtccatgccctatcccacagtctcgggggcatgctcgacctgccccatggcctgtgcaacgcgattttgcttgaccatgtcattgcctacaactacgactccgccccggagcgctacgacgccttgggacaggcccttggcgcggccatggagcctggcgcgtcccaggactgccggcgcgcggctgtggtccaggccttttccgatttcaagcgccgcctgggcgtgacccagggactggctgaactcggcatctccccggcggttttcgtcgatctggccaggcgcgccctggatgatccctgcatgctcaccaaccccagaaagcccaccctggccgaactcgaagccgtctatgccagcgccagccgatccctcgcctagggccgacgaacgcctcacccggttgctcgggtttggcgaacattcggtcagcaagagctattatcccgagctgcgccgccgcctggaggagcttgagcgcttccgttcgcttttggaccagaccggcgacgccatttttctcgtggatgtggccacggggcgcatcgccgacgcggccggcgcggccggggccatgttgcggcaggagcgcggcgatctgcggggactgccctttgagcattttctgcctcccgacgccgtgttgcggctgcgggggcttttttccggcgatttcgccgccgggcgcgtggagacgagcctgtcgcgtccgggcgacgaggccggcggcagcctgcctgtggagatgacctttcgcctggcccagggcgaggccggccgggtcgccgtcatcgtggcccgagacgtcaccgagcgcaaaaaaaatgaggaagccctgcgtcgggccgaggaacgctaccggggcatcgtggaaaacgccgccgaaggcatcttccagagcaccctttccggtcggctcatgaacgccaacccggccctggccgcgatcctgggctacgccaaccccgacgacctcctgcgccacgtcaaaagcgtggtggacgaggtggtggccgctcccgaggaccgtcaccgcatccgctccgagctggaccgctacgatgaagtaaaaaacctcgaagtccaactcatcaccaaatccggtgcgcacatttggggccttattaacgcccgccgcatccggggtgaggagggcacgcccgagcgcttcgacggctcggtccaggacgtcaccatccgcaaacaggccgagcagacgcttatccgctaccacgacgagcttgagcagcgcgtggccgagcgcaccgccgaactcacccgtataaacgagcgcctcgtccacgaagtgaccatccgcaagcgcgccgaggaagcggccgaggccgccaaccgggccaagtccgattttttgtccatggtctcccacgagatccgcacgcccctgacctcggtcctcggctttgccgtgctcatcaaaaagcgactggccagactcctgcccgcctcggccgtggatacgcccaaaaagcgcctccaggccgagcagatccaggacaacctggacatcatcgtggccgagggagagcggcttaagcacctcatcaacgacgtgctcgatctggccaagctcgaagccggtaagatggcttttaagtccgagcccgtggacccggccgaagtggtgcgccacgtcatgaacgcctcggctggactgttgcaaaatacgaacatcgtcctggacacccgcatcgagggccgtctgcccctggtccggggcgaccgcgaccggctgattcaggtgctggtcaacctcgtctccaacgctatcaagttcaccgaccaggggtatgtcgcctgccgggccagggctcagggcaacaccatcgtcatcgaggtcagcgacaccggcatcggcatcccggaatccgaacagggcaaggtgtttgagaagttcaaccagatcggcggcacgctgaccaacaagcccaagggcaccggattggggttgaccatctgcaaacacatcgtggagtcacacggcggtcgcattttttgtgtatctcggcccggagccggcagcacattcacctttacgctgccgattgcctaagtccgcctgttgcggtatgtccccgtcccccggcggcgtggccgccgcccgccgcaaacgcccttgaaggattcctgcatgaaaaacgtcgccagaaacgaagccctgcgcaatatcgccatcatcgcccacgtcgaccacggcaagaccaccctcgtggatcacatgttccgccaaagcggcctgtttcgccagaaccaggaagtcacggaccgcatcatggacagcatggatctcgagcgtgagcgcggcatcaccattgccgcgaaaaactgtgccgtgatctggaacggcgtgaagatcaacatcatcgacaccccgggccacgccgacttcggcggcgaagtggaacgggcgctgtccatggtcgacggcgcggtgcttctggtggacgcttccgaaggcccgctgccccagacccggttcgtgctcaaaaagaccctggatcggggattgcccgttatcgtcgcggtcaacaagatcgaccgcaaggacgcccgggtcgaggaagtcttgaacgaaatttacgaccttttcatcgacctcgacgcctccgaggagcagcttgaatttccggttctgtacgccatcggccgcgaaggcatcgccaagcgcgagctcgacggcgaaggggccgatctgtccccgctgtttgaaaccatcctggccgagatcccggctccgtcccacgatccgaacgagccttaccggatgcttgtctccgacctcggctattccgagttcctgggccgtctggccgttgggcgcgtggtctcgggcacggcccgcatcaaccagaccctagttcgcatcgacgaggaaggcgcggtcaagccccttcgcgtcaccaaactgcaggtctacgaaggccccaagctcaccgagaccgaggcggccgaacccggcgacatcctggtcatttccggcgttgacgaggtgaccatcggcgacaccatcaccgtggccgacgcgcctaaggccctgccgcgcatcaacgtggacgagcccaccgtgtccatgcgctttgccatcaacacctcgccctttgtcggacgcgagggcaagttcgtgcagtcggccaagctgcgcgagcgcctttacaaagagaccctgcgcaacgtggccatcaaggtcgaggagaccgaggacaaggatgcctttacggtcaagggccggggcgaattccagatggccatcatcgtcgaaaccatgcgccgcgagggcttcgaactgtccgtggggcgtcccgaggtcatctacaagaccgaaggcggcgtgcgcaaggaacccgtcgaacacctgtttatcgactgcgacgaggcctttgtcggcgtggtcaccgaaaaactctccatccgcaagggccggatgctcaatctggtcaaccatggctcgggccgggtgcgcctggaattctccatcccgtcccggggccttatcggctaccgcgacgagtttttgaccgacaccaagggtaccggcatcatgaactccatattcctgggctacgaggaataccggggcgacttccccagccggtttaccggctccatcgtctgcgaccgggaaggtgttggcgtgccctatgccctgtttaacctcgaaccgcgcggccggctgttcatcaccccgggcgagccggtctacgagggcatgatcgttggcgagcacaaccgcgacaacgacatcaacgtcaatccctgcaaggaaaaaaagctcaccaacatgcgcgcctcgggcaaggatgaaaacgtcatcctctcgcccgtgctgcccatgaccctggagcgcgccctgcacttcgtgcgcgaggacgagatggtggaggtcacgccgctgtccattcgcctgcgcaagagcgtgctgcccgccaaggaccgccacgtcctcgacggcgctaagaaaaaagacaagtaagagagagaagaggcctccggcggctgggggcctgaggcccccagaccccccacctgggaaaagggttaagggggttgggtccgtcttggctgcagcagtcggtggaatgtccccgacgccctcgaaaaggggcgatggagactattagatacggaatattgcgacggcttctcccgggcaagcacccggcgggaagccgtcatttttggcgtcgcggcggaggctggtcgcgattgccagcccgcgcgccttcgggcatgagagtggcatgaatacgttgcagtccatgcccggccccatcggcatcgccgtgcgctaccttggcgtcgtggtcctgctcgccgcctacggcggccaggtctgacccttcattgaggccgtgccccccgtgagcctgggggccatgctcagtcttgcctttgccgtcgccttgatggcccgggggcttgtcctgcgccgtctggtcctgtccgcgccggccggggagcagcctgtgcgccagtttgccctggagatgggcgcgtgtctgctcggcggtctgcttaccggtttgaccatggaagcctccacgggctttccctgggctcccggctggaaaatcgtgctgggagccacggccgccgggttctaccttggcttggaaggggcacttttgcgccagcgtgaggtcgtcttgcgggccagagaggccggttacgatccggtctggcggcccaagcgcctgcgcagcctttcacggcgcttcttgaccgtggccgccacggcaacggtgctgcttttgggtatctttggcctcatctgggccggcgacgtggactggctgtccaccctggaccgcgatccggccgtgctggcccaggcccggtcctcggtcatcgtggaaatcgcctttgtcatggccgtgctgctgcttggggcggcgaggctgatcctgctctacgccggtaacctgaagctgctgttcaacaccatcaccgaaggtctggcccgggtgcgccagggcgacctgtccgtgcgtctgcctctggccacttccgacgaatttggccttatcgccgccgaggccaattccatgatcgagggcctttcccatcgcctggccctgcttgacgccctcaaggtggccgaggacgtgcaacgaaacctgttgccggccgcgccgccggacatcccgggcctggatatcgcggccttgagcgactactgcgacgagaccggcggcgactattacgatttcatcgaaaccggaccgggccgcacggccattgtcgtggccgacgtggccggccatggcgtggggccggcgctgctcatggcctcggcccgggccacggtgcgcatggccgccgccatgtatcccgatctcggttctgtggtcagcgccgtcaattcccgggtggccgaggacgtgtacggcaccggccggtttttgacgctgttttatctggagatcgacgtggccgcccggatgctgcgctgggtgcgggccgggcatgacccggccttcgtggtgcagcctggccaagaggaggcgacgctgcttggcggcggcgggccgcctcttggcgtggtggagggctatcggtacgtggccgagtcctgcccctggccggccggcggactggtgtttatcggcacagacggcatatgggaaaccaccggcgaaggcgagggcatgttcggcaagcgtcggctcgtcgatttgctgcgaaaaaatctcggccggcccacggcccaggtgcttgaggccgtgcgccacgacctggaggccttcagccacgacaagccccgggaggacgacatcaccatggcggcggtcgcgtttccctgaggccctcccggtaggcggcttgctcggctcccggccatgggctatgaagccccggacgcaccatgaaaacccgcatcatcgacgtcgccatcaatgtctacggcaaaccggcacagaccgctctggccctggtttccttgctggcccacagcggccggttcattgaccgtatctacttcaatgaagaaccggacggactcaatgcggtttttgaccatgacgacctgctggccgccttgggtgaccgggtggtgcgccaccggccatcattcatgaactggcgttacgccgtggacgaagcccgtctgggtgacccggcttatcgccacgccctgcgctaccaatacgccttcgagcactccgacaagcggtatctgctcatcatccacaatgactgcgagttcaccggcgacgtggtcggcttgcttctcggcgcgctgggggctcacagcggcgcaggggagatcggccaatgctggctgtgtccggcggccatgctcggacgctgcggccccgggcgttaccgtgactatcgcccggatttcgccgaactggccgctctctacgacgccatcgatcctgccgtttatcgccgcatgtatctgcaggaaccgaccgatgcccttcgaaatcggccctggcccttgccggaatgccggctcaacgaattttgttgcttgttgcgcctggaccgggttcggcccgatacctgcccgcagggtttggcccggcctttcggcgcgtatgtggacgtcggcaacccctataccggcaacggcatcctcgacatcggcgtggcctggttcggcgacatggtccatttgggccattctttcgtccatgtgcccctggcttcctgcgtgcgacacgaaggcggccacaggtcgcttttcgcaccggacgactacgtgaaacgcgaagaacaagcgattgctgtcctgcgcgacaaatacggcgcgtcctgacgcgcctgggagccgcaatggcgcttttcaccgttaccgatgcctgcaccggctgcggtctgtgcgtggccgcctgtccggccagtctggtgcgccaggccaagcccggcgacgccccccatgccctgccgggccgcgaagcccactgcatccgctgcggccactgcgtcatcgcctgccccaagcgggcctttgtccacgccttgcttccggccgaggcctttgaacccatccggcgcaaggacctgcccacgccggccgccttgcgccacctgctcatggcccggcgctcctgccggacctacgccccggaaacccttttccgccaggccatcctggggctcattgagtccgtgcgccatgcgcccaccggccataacatgcgcgaggtcggctgggtggtggtggacggtcccgagcgcatggacgcggcccggacgctcgtgctggactggatcgccgccgaggtggcggcggacacgcccaaggccgccgaactgcatctggccggcgcggcccgggccgccgcccggggcaaggacgtcatctttcgcggcgcgccccatgttgtcgtggcccatgccccggccgtgggcatcagtcccgaggtggacgcggtcatcgccgcctcgtggctggagatcgcggcggccgccgccggctacgccgcctgctggtgcggctacctgatgttcgccctggccagccatccgccggtggggcaggccctgggcatcccggccggcaacacgggctacgccgcgctgcttctgggtaagcccgccacccgggtcaagtggataccgcccagggagatgccggaagttctattcttctgagatacggtataggctttttgttgacgtcgcttcgtctctgtggtctgtgtcagaaatgacaggatacgcgagagaggcgaggtgtctgtgacatgacggaattccaagcttatctggtcgtcgctttgtccgtggcggcgctgtgcatttcccttctcagctatctttccaggagaactgcgcaagcatccgggaaacgtcaagcttggcataatgcagtcatttcctggtcgtccggcgtgatggatgaaatggagacggtgctgcatattttcaagcaattgaaatatggcgcgtcctttgatgacgtcatggatgaaatcgtcgtgtcgaagagcaacatcagcgtgttgttggattacggcgcgctgttgatcacccaatcgctggatgctgcgggcaaagaggctgtgtcgggaggggaaagtaaggacgccttgaaagcggttgcggcggtgcacgccagactttgccgtgccacggattcaggctgccgcctggatgtggaagaaagcatcctgtatgtcgcgcagtgtcgaaaaatgtttatcgatgatatccggtcaaacatggcgttggcaagtccagacaacagcgtgccagcaacactctggaaaaattagtgttgcttctgctttcttttcgccaaacgccccggccgaggttctcggctggggcgtttggcgtcagggcaaggggcttcagccgagcacagcctgctttatggcctcgatgcccaggcgctccacgaaccgggcggcccgctcgcgcttcttggcgttggcggcgtagtagccgataagcttctcggacagctcgatgacctgctccttggtgagatcctcggccaccacgtcgccgatccgcggccgggctccggggtggccgccgaaaataaccgtccagccggactttttgcccagcacgcctaggtcgcgcacaaagctctccgagcagcaaaacggacagcccgacaccgacagcttgaacttgcccggcaggtcgcggccgacaaagagcttttccatctccagtcccagccccaggctgtcctggacgccgaacttgcacacgctggtgcccgggcaggcctggacgaaatgcacgcacagttccagggcctggcccacgtccgtgcccaggtccttccaaatggcgtccacgtcctcggccttgaccccgaccagggccaaacgctggccggaggtgatcttgacgatggggacggcgtatttcttgacgacgaggttgagggcttcgagtacctcgggggaaataagccccaccggcgtgcgggggacgatggcgtaggtctgctggtcacgctgtaaaatggccccggtgggggcgtcgttggcgctcatggtggctcctttgcggatggtctgagggggatggggatatatgggcctgcgcaagctgcgatgggcggccggtccgttgtccgagggcggcccgggagagcggccgccaagggatgaccttaaacacggatcgcggccttttgtcaccttcaaaaaaaccgccagggatgccgggtggtttgtcttgacgggtttggcggccgccggagggcggagggcggtcaatgcgcgaggaaacaaagcctggcgacgcgttttgcccggtggccggccttgagtccgaggcctgcctgggctacacaccccggactacaccccgccgggaggctgtcttgggcaagctcaacgttgaaaaattgtccccaaatccggaattcgatctgttcttgtatctgcgtgtctgcggcgcacccaaggtcgaacagcacgtcatcgatctgtgccagtcccagtgggacaccttcaaggaacacctcaagggctaccgcttcgctccggccggctccaagcgcggcgtggtgctctatttcctggaacccgccgccgagggcctggtggaggaagcctggggccgctcgcccaccgaaggcttcgccatccacaatctggccgtgtccatggtcatggccgccgccggggagcaggtcccggaaatcgaggccggggcttgcgcgcccctgcccaccccggaccgcgacctcaaacgccgtattgagcgcctgggcctggtctggaacgaggtcggcaacgtcagcgtgcagtacgccgtcatgacccacgatccctatcttggcggctgcaccgtttgccatctgcgcgcgtcctgccccaaaagcgacgtgcccaagggcgcgtaagggcgatcaaacgggcagcgcccgcagccaacggaacgcctccgtcggctgcgggcgctgcccgtttatggctggttgattgccagatcaccagatgttgcggaccttgacgcctcgcttggccatgtggtccttgcagtccttgatgctgtattcgccgtagtggacgatggaggcgatgagcgcggccgaagccttgccggtggtgacggcgtcggccatgtggtcgggattgccggccccacccgaggcgatgaccggaatggtgacggcttcggcgatcatgcgcgtgagcgtgagttcatagccggtcttggccccgtcggcgtcgatggagttgcagcagatttcgccggctcccagggcttcgacggtcctggcccactccagggcgtccaggcccatggccttgcggccgccgtggatgacgatttcatagcccgaagggatctgttcggacacgccgacatgcttgacgtccatgccgaccaccacacactgggagccaaaggcggccgcgcccaggctgatgatgtcggggtttttgacggcggcggaattgaccgagattttttccgcgccggccagcagcaccgcccgcatgtcctcgacggtggagatgccgccgcccacggaaaacgggatgaagatttcccgggccacccggtccaccacgtcgagcatgatgccccggccttcgctggaggcggtgatgtcgtagaaaacgagttcgtcggccccggcctcgtagtagaggcgggcggtctcgacgggatcgccgatgtccacgttgccttggaacttgatgcccttggtgagcttgccgtcgcggacgtcgaggcagggaatgacgcgtttggagagcatgtgttaagcctcctggcaataggcggcgaagttgcgcaaaagcgccagccccgggcgaccgcttttttccgggtggaactgcacggcccaaaggccacggcgtccgtggacggaacagaaatccaggccgtaacgggtgaggccgaggacgtattcccgggcgggcacgggatagtagctgtggacgaagtagaattccgaggccgggtcgatgccgtcgaagagttcgcattccttggccagggcgaccttgttccagcccatgtggggaatgcggatgggctggtcgtcctcgtcggtgagcgccgggttgaacatggcgcactggccgggaatgatgccaagggccttggtgtcattttccgggctgtagtcgaggatgatctggcaaccgagacagatgcccagcagcggcttttcggcggcgacctgctctgctaaaagggcgtccaggccggtggcggtcaaatggcgcatggcctggccggccgcgcccacgcccgggaagatcaggcccgaggcgtcggcgatgacggctggatcggcggtgatgcggcagggaatgccgagatggtccagggcgcgccgcacgctggtctggtttccggcctcgtagtccaggatggcaagcatggagttctccttcgccgggaaggtcgtcccgaaaaggcggtttggcccgggcgggacgcggcattgcggcggccaagccgccggggtttcgcagaaggcggttgtgaacattttaggcatttttggcaagggaggcgggcatgatcatcgtcacgggcggggccgggttcctgggcagcgggctggtgtgggggcttaacgccgccgggtacgacgacattttggtggtggacaacctggggcacggcgacaaatggaaaaatctcgtcaatcgccgttttgccgactacctgcacaaggacgcctttttggaggccatcgccgaggccaaggacccctttggggccacgtccgtcatccatctcggggcttgctccgccaccaccgagaccgacgccgagtatctcatgcgcaacaacacggcctataccaaggccgtggcccgctatgccctggaggccggggcgcggctggtcgtcgcttcctcggccgccacctacggcgacggcagcctggggtttgacgacgacccgggcggcctgggcgcgcttaagccgctcaacatgtacggctattccaagcatctcttcgacttgtgggcgcggcgggaaggcttgttggggcaactggccagcctcaagttcttcaacgtctacggccccaacgagtatcacaaggccgacatgcgatcggtggtctgcaaggcctacgcccaaatcggcaagacgggccggctgtcgctgttcaagtccagccgggcggactatcccgacggcggccagaagcgggattttctgtacgtcaaggacgccgtggccgtgatgctgtggctgctggagcatcccgaggtgggcggggtctacaacgtgggcagcggcgcggccaggacctggaacgatctggcggctgcggtcttttcggccatgggaaaggccctggccgtggactacatccccatgcccgaggccatacgcggcaagtaccagtatttcaccgaggccaaaatggatcggctgcacgccgccggctgcgccaactccttcatgactctggaagagggcgtggccgactacgtgaagggctacctgtcccagcccgaccgttatctttagcagctcctcatgccatggaaaacggccggccggacgcctcgcgtccggccggccgttttcctatgcagggggtccgggggcctcaggcccccggccgccggaggcatcttcctctttgtcttcccttaatcgtacttcaccgcgctgatttccatcagcttatccaaccggatgcgggtttcgatgcggcgcatggtgccggttttgccgcgcatgaccagggagtgggtgacggcgtgggtgccagtgaaggccacgccttcgaggaacgcgccgccggagatgccggtggcggcgaaataggtgtcgtcgctgcgcaccagggtttcctcggtgaagacctgcttgcagtcgatcccggcctcggccagggcggccgcctcggcttcggactggggatcaagccgggccagcatccgaccgccaagggcccggatggcgcaggccgagagcacgccttcaggggtgccgccggtgccgcacatgacgtccaccacgttgtccgggtccacggccatgagcgaaccggccacgtcgccgtcggtgtggagctggatgcgggcgccggcggtgcggatttcctggatgagcgccttgtgtcgcggtttgtccaggacaaagaccacgaggtcgtccatgtccttgcccagggccttggcgattttcttgagattctccccgatgggcgcgtcgagttccacggcttccttggcctggggcgggaccacgagcttttgcatgtagtagctgggtccggggttgaacatggagccgcgcggggcgatgccgaccacggagatggcgttgggccggccgtaggccagcaggttggtgccttccaccgggtccacggccacgtccacggcatggccctggccgctgcccacgcgctcgccgttatacagcatgggggcttcgtctttttcgccttcgccgatgatgatgacgccgtcgatgggcagggtgttaaacgacaggcgcatggcgtccacggcggcctggtcgccggcgttcttgtcgccgcgtccgagccagcgcgaggaactcaaggccgccgcttcggtcacccgtacgaggtcaaggcccaggtttctgtccggcgcttccatggcaaggctccttttgtgcgggcgggagaggatgggaaggcccggcgcgccgtcccgtcggccatgccgggcgttattccaaaaggccccgcgcgcctgcgcgcgcggggccggctaaacggaaccgtaagcaaccggggcgtcccggccgatgttatcgacgttcccaggcggccttgacggcggcggccagggctgtgggcgtgaatccataggcctcggccagcttttcggccggggcggaggcaccaaagcgcgagatgccgtggatgcggtccatgcggccggtgtactggcaccacagctcgggccggccagcttccacggcgaagcggaaggggatggccgagggcagcacgctttccttgtaggcctcgggctgctcgttgaagatctccatgcaggggatgctgacgatgcggatggccagctccggcaagagcttggccgcggccatggccagggagacttccgagccggcggccagaaggatcatgtccggcttgccgccttccggctcgaccaggacgtagccgcccttggccgtcccttcctggagtccgggatagtgggccggatcaaggaccgggaggttctggcgggtgaggagcagacaggtcggccggttgacccgggtcagcgccatttccaggcaggcgcaagtctcgtaggcgtcggccgggcgcatgacgagcatgtttggaataaggcgtagggagctggtctgctcgatgggctcgtgggtggggccgtcctcgccaacgtagaaggaatcgtgggtgaacacgtgcagggccggaatgcgctgcagcgcggccatgcgcagggcgttgcgctcgtagtcggagaagatgaggaaggtcgcgccaaaggccatgagcccgccgtggagcgtgatgccgttgacgatggcccccatagggaattcgcgcacgccgaagcacagggtgcggccgagtttgttctccggcccgaagacgccggtggtcttgcggaacttctcggtctggttggacggatcgaggtcggccgaaccgccgacaagaagcgggaagtccggggtgatggcgtccagcgccttgccccaggccgaacgggtggccacggccttggccgggtcgaaggtcggccagttgaaggtccggttgcccggggcgcgcttggcctgccgccagaggtcctcgaagccggcgtcggcggccagcttggcttccagggtcttgtcccaggccttgcgggcggcgaccagctcgggccagcgggcgcggaaatgcttgcccacctcggccggcaggtagaatttccggtcttcgggcaaaccgaggtttttcttggtggccttgatctcgtcttcgctaaagggcgcgccgtgggaagcgcagtcgccctccatggtgcaggaacccttggcgatggtggtcaggccgatgatcatggacggccgggaggtttcggccttggccgcctcgatggccgtcctgatggcggcatggtcgtggccgtcgatctcgacgacatgccagcccatgctcgtaaagagcttagcatagtccacatggtcgcagatggccaccggccccgagagctggacctggttcttgtcgaaaagaacgatgagccgtcccagtccccacaggccggccagggcggccgaaccctggaacaccggggtctggacgtcgccgtcggaagaaaggacataggtgtaatgcccggcgacgtcgtcgcccaggcgctcgcgcaacatggcctcggcaacggccatgcccacggacatggaaaagccctggcccagcggcccggtggtgcactcgacgcccggggtctcgtaattctcgggatggcccggggttttactgccgaactgccggaaatgctcaaggtcttccatggtcaaaagcccgcgcagatgcagcaaagcgtagagcagcatggactcgtggccggccgagagcacgaaccggtcgcggtcgaaccaggtcggatcggccggatcgtagcgcaggtagtccttgaacagcacgtacgccatgtccgcggaagacatggctccgcccgggtggccggaggcggccttgcgggtggcgtccatgatgaggcctttgatgacgttgacggcctgggcgtcgctggcggatgcggtggtcatggagggttcctcgacagggcggttggaaggttgtctacagcccgcagccgggccggcaggtttcgatcaggtccacgcggcgctggtggcggccgccttcgaaggcggtgtccatgaaggcgtcgacgatggaggcggccagcccctggccgatgacacgctcgcccaggcacaagacgttggcgtcgttgtgcaggcgggtcatgcgggccaggtattcgttgacgcaaagggcggcccggatgccggggatgcggttggcggccatggacatgccgatgccggtgccgcagatgaggatgccgcacgatcccgtggtttccaggaccttggcgcacacggccttggcgaaatcggggtagtccacgctcttggcttcggacgggccgagatcgaccacggcatggccggcagcggcgagatgggccgcgacaacggttttgagttccaggccggcatggtcggagccgaggaaaacggtcttgggcatgggcgtactccgcgtggcgcggtttaaagttccggcaaaagcccgccgtcgccggcggcgtccaggggccgcacggccacgtttggcgggacgggcagttccaagtcggcggccgggtagggggccgggcggggggagagggtcttgacgcgaaggataagcgtcgctccgccgggggtggtcaggacaaggcgtctggccacgggcgcgccatagcccggggtcgcctcgtcgtcctcgaaatcgatgcgccagggttccacgccccggccggtcagatgtcgcggtttcccttggaagtcaagggtgagcgaggacaggcgcgggtcgccggtaaaggcgtattcgtagccgccttggactttcttggccgaggcataacggggcgaggccagttcgcccaggcgtcccgagacgatggcggccaattcgcgcagggtaaagggcagaggcatcccgagcttggccgcgccgacccgggtgtcggcgtgggtgtaaagggtgtcgcggctgggcacgaaggcggtgaattcgccgccggcctcgcgcagatgggcgtaggccccgcccatgggcgtggtcaggtccaggcgcaccggcgcggcgtagttgccgaaaaagcggtagttgagccggccgctcttgccagcccgggcgaagctcaaggaaccggacagggaaaaggccttggccggctcatttttggcttgggcgtccaggaaagtctggtagacggccttggcctcgtcggcggggcctggcgcgccgggtttggccggggcgcagccgccgagggcggccacgaccagggcggcgaaaagcagcaggcgggcgggcagggcgctgcggcgcatttacagggcctccagcttctttttcacggcggccggcgtctcggagccgagttccagggcactgcggtaggccttgcgagcctcttcgggccggccggcggccacggcgatgtcgccgtagtgctcccagatgatggcgtccttgaccttctgggcaatggccttttcaatggcggcaaaggccgcgtcggttcttttgagcttgtacaacgtccaggccagggaatcgagaaaaaagggattgtccggctctttttccagggccttttcgatcatggacagggcccgctccagatcgcggccttcctcggccagggaatagccgagatagttgagggcatcagggtggctgccgtccttggccacgatgcgttccatgacggccttggcctcgtcgcggcgtttgagtttttccaggcccacgccgtaacggtagaggatatccaggtcgtcaggccaggtcttgacggcttcttccagggtcttgaccgctccggcgatgtcgccggccttgtccttgacggcggcttccagggcgacaaactcgcgccggtccgggaagcgctccctggcctcgcgcaccacggcggcggcggcagccatgttgccggtttcggacgcaatctggacgcgaaagctcaagctcttgtcgtaattcggattgtccgccggcaccttggccagaatggccagggccgccttggggtttttctcgccttcataggtgagcacggcgtcgtagaagggcaggtccgggcttgacgggtcggcggcgcgcagcatttcgtaaacctgccgggcctgtttgggctggccggcctcgaccagggcggacatggcgtcgaggtattgcgatttgccggtggggccttccttgagcagggccagcgccttggccggatttttctggcggatggccaagcgcacgagcttggcccgcacctcgggtgattcctcgccaagggacagcatccgctggtaggcgtcctgggcgcctttgaaatccccttcggcttcgagcagggcggccagttcggcccaggccggcatgaggccggcgtcggcggccacggcggcccggtaatggcgcatggcgtccttggcccgcccggagcccgcggcggccttggccatcaaatagagcaccgtggcgtcgcgttcgccttcgggaatgcggcccagcagttctccggcctccttgttgcggccggcgtcgatctccagcgaggccagttcctggacggcggcgtagtccttgggctggctggccaggaaggattcgagaaccttgatggcctggtcgttgagccggcgcatctggtaggcgttagccagatagaaattgacctgccggctgccgggaaaggcggtccgggcttgttccagggtttcggtggccttttcccgctcgttttgtccccagtagaggttggccagctccacggaaagatcgggcgaggggtgggcggcggccagcccggccagggtctgggcggcgtcctccttgcggccctggcgtaggagatcctggtagaccaggaactggtaattcacctcggccgacggggacagaccgcgcgccgcataggcgttgcgggccagccggctggaggcgcaggagttggacaacagacacggcaaaagcgccaggaccagcaggactggcaggcgcgccgggaacaggcggtttcgtgcttcgggcatgaccggcatccgttgcgccggccggccccgccgcccggcaaggggcggcggggccggcttggcggcgctattcgtccttgtgaatccagtccgaggaaaaatcctcgatgcgtttggacagatgatccttaagcttttccaggagccgggattcgatctggcgcacccgttcccgggtgatgccgtatttcgcgccgatttcccgcagggtcacgggagagtcggacaggatgcggttgtcgagcagctcaatctctttctcgttgagcttgggccggatggactggatgtgcttgtcgagctggtgcgagatctcgtcgccggccaggatctcctcgatgccgggcgtgagcgccggcaggaaatccagacgcgtggacgtggtgtcgtcgcctagggacacgtccagggacagatcgttgccgcttaagcgctgatccatctccacaatgtcggattccgtgacgtttagggcctgggagagctgggcggcgctggggtcgaagccgaggctttgcagacgctggcgttccttgttcaaattatagaacagtttgcgctgggcctgagtagtcccgatcttgaccatgcgccagttgtccatgatgtacttgaggatgtaggccttgatccaataggcggcgtaataggagaatttgatgcccttgtccgggtcgaacttggtcacggcccgcatgaggccgacgttgccttcctggatgaggtcaagcacgttttgcatccagcggcgctggaagtccatggcgatcttgaccaccagacgcagatgggaggaaatgaggcgaaaggctgctttttgatcgttcgcgtcgcgcacccggcgggccagttcctgctcttcctcgggcttgagcatgggaaacttcccgatttcacgcagatagagctggagcgggtcacgggtggagagcgaaccctcggagcgggggcgcggcgctggcaaagtgaacgtgtcggcagcgtctatttcaaggtcggggtcgagggttggttcgtgggcgtcgtcgtcggcgtcggcgtcgagcacctcgggctcgaccgggtcgaggtccgtgtcatcaggggaaatttcttgatcgtcgtggatttccatcggatactgaccgtgcttacgggtgcggccgcaccgcttgagttggcccgggcaggttgcccgcgccggtaaaggcgctgtctcgcatgcctacctctccctgtaaagttttggtttgtccttttcaatgtttttcagtagacgggccgcgtttctcgtcaacgacaagcgggccgccggccggctgaaggagatcttgtgggcgatttcagaaaggcgcttgccgacgacacgctgctcctgtttgacggagccatgggcaccctgctccagggccggggcctgtccgccggtcagtccccggaactgttcggcctgaccaaccccgacgccatcatcggcgcgcaccgggattatgtccaggccggctcccgggtcatcaccaccaacaccttcggcggctcgcgctacaagctgccggccggcaccgacgtcgccgggctcaaccgcgaaatggcccgtctggcccggcaggccgccgggccgggcgtgttcgtggccggctcagtcggccccaccggccactttgtcgccccccttggcaaagccagtctgcgcgatctggtcgaggcctttgccgagcagattcggggcctggccgagggcggctgcgatctcatcattggcgagacccacttcgacctggccgaggccaaggccgtcatcctggcctgccggcaggtctgctccctgcccgtggccatgtgcatgaccttcgaaggcgcggccagcctcaccggatcaagccccgaagtgtttgccgacgccatggagaatttgggcgtcgcgcttatcggcgtcaactgcggccagggccccgacgacatgcgcctagtcggcgaagccttctcgcgccgcctgaaaacgccctttttcgtcaagcccaacgccgggatgccgcgtctggaaaacggccgcaccgtatttcccatgggacctgacgaattcgccgaaaagaccgcccgctttgttgatctcggggccaaggccttgtccggctgctgcggcaccaccccggcccacatcgccgccttgggcgcggcccttgccccccgcagctggaagcgggtcgacacgccagaccgcccggtcctggccgtcacctcgcgctccatggtcgtgcccatcggcggcggcgcgcccctggccgtcatcggcgagcgcatcaatccaacaggcaaggccgagctggctgccgaactggccgccggagagttcgccaaggccctgcacttcgccgaggagcaaaccgctgccggggcgcatattctcgacgtcaacgtgggcgcgcccatggtcgacgagacggccgtcctgccggggctggccctggaactggtcaagcggcagcagttgcccctgtgcctcgattccaacaacatcgacgccctgaccgccggcctgtgggcctatccgggcacgcccctggtcaattccatcagcggcgaacccggccgcatggagcgcctggggcccgtctgccgcgaccacggcgcgccgtttatcctgctgccgctcaaaggccgcaagctcccggtcagcgccgccgaacgcctggccatcatcgaggagctgcttctccaggccgaggccctgggcatcccgcgccgcctcatcctggtcgatgctctggcgctcaccgtctcctccaagcccgaggccgccctggcctgcctggaggtcatccggacctgccgggacaagtgggggctgcccaccgtgcttggcctgtccaacatttcctttggcctgccgggccgggagctcgtcaacagcgcctttttcgccatgtgcctgggggccggcatggccgcggccatcgccaaccccaacgtgccgcgcctcatggagaccttggccgccggcgaggtgctcatgggccgcgatccccaggccgggcggtacatcgccggctacgccggctggaagcccagttcgggcggcgggaacggatctccgtccggcccggcctcgggcggggccgacgacggccaaagtccgctgcgtcgggccgtggtctacggccggcgtgaagaggtgctggagcgcatcgaaaaggctttggccgagggagccgacgcggccacgctgcttggcgaggagcttattcccggcatcatgagcgtgggcgagcgctacgagcgcaaggaattctacctgccccagcttttggccgccgccgaggccatgcgggccggcttcacccgcctggagccgcttctgaccgaggccggcgcggccgccaaggcccgcattgtcatggccacggtggagggcgacatccacgacatcggcaagaacatcgtgtgcctgatgctcaaaaaccacggtttcgaagtcatcgacctcggcaaggacgtgcctgcggcccgcatcgtggaagcggccgaggagcacaaggccgccgtcatcggcctttcggcgcttatgaccaccaccatggtgcgcatggaggacacggtacgcctgctgcgggacaagggcctggccatcccggtcatggtcggcggggcggtggtcaccgaggcttttgccaagtccatcggcgcggccgcctacgccgccgacgccgtggacgccgtgcgccaggccaaggccctggccggcggggcctaggggcgcgccctcgacaaccgtcgaggacgattcgcggttattttacataaatatttgatttatagtgggaaattctgtcgcatttgttaaggggcgcgacactggccttcgcggccgaccgggagtactgagcggtgatcatgctgtcgccaatcgtttcccgaaaggcgcaagcggcctgtttcgaacccgcggcagtaggaaaaaacaactggcgcggcccggcgcgtttggagtaaaagctcctggcggccacgccgcgcaatcgcactcgtggaggacgccgttgcgtatttcttccctcatgctggctctggcgcttttgtgcctgcccgccaccaaggccttggcccaggacgccggaaccataaacggccagggcgtccttgacgccgtggtcgcggcccagggcaaggtcgtggtcatcgacttcttcgcttcctggtgcaagccctgcctcatggagattccggagttcattgaggcccgcaagcactatcccgccgacaaggtggtctttatcggcatctccctggaccaggatcaggggcagtacttccgcttcgtcaagcagacgcccttcaattttccggtctatctggccgatcccgacgtcatcagcacttttggtgtcaagatgattcccaagaccattatctatgacccggccggccagcaggcgctcaaccattccggcttcatgcccggcgagatgctgcgccagattctcgacaagctcatcggcggcgagaaatgaacgggctattcatccgcaaggcgagaatccaggacgtcaaacagattcacgcccttttgatgagctgcgcccgcaaggaattcttgctgccgcgttcctacaaccagctctacagccacctgcgcgacttctttgtcctggccgagcacgacgccccaggcgttcgcggctgctgcgccctgtccatctgctgggaagacatcgccgagatccgttccctggccgtggacgaggacatccaaaagcaaggctggggcggcaagctcgtggaagcctgcttgtccgacgccgtgacccttggcatcttccgggtgttcaccctgacctaccggccgcactttttcgagcggctgggctttgcgcccgtggaaaaggagcagctgccccagaaagtctgggccgactgcatccattgccccaagtttccggagtgcgacgagaacgcgctcatcatggaaatgtaggctttttcgctttattattataaaatcaaacgcggggaacaatgtccgagaccttgcgagaagtgtttggccaggcggccattgccgcccgggtggccgagcttggccgtgacgtgtcggcggcctacgccggccaggatgtggtgcttgtgggcgtgctcaagggcgcgttgccgtttatggccgatctgttgcgggccttggatttctgcccggaactcgatttcgtgcgcgtggccagctacggcgcgggtgtggctccgggagcgctacggtttctcatggacctcgaaaccgacatcgccggccgccatgtcctgctggtggaagacatagtggacaccggccgctcgttggcctatctcctcaatatgcttaaggagcgaaacccggccagtatcaaggtctgcacgctgctggataagccttatcgccgtgaggtcgatgtgcctgtggatttcgtcggtttttcggccccgccggtgtttctggtgggctacggcatggacatcggcgaacggctgcggcggctgccggcggtttacgaactgatccaagaataatggctttgaaattgcagaggttggcctaaaaacgcaaccggcgcgggaaagaaaacatgatcgtacagtgccccaattgccaggccaagttcaacctccccgacaacaaggtcggttccgacggggccaagctgcgttgcggcaagtgccgcaacgtctttcacgtcgatccgcccgcgccccccgagtcctcggatctcggcggcctgacggatttcgatttccctgacgatctggccccgaccccgccccgggccggcgcggccggcggtgatcggcccgggccgtccattcccgacgacggcgtgccgggcgacctgttccattccgagtcctacgccgccccggcttcgcccaagaagcaagccgcccccgagccggacgccgacgacgatttcccgggtgggccggtcaagccgggattcagcctcgacgacgtggccgatctgcccctgccgggcagccggccgtcaaaagaacgacgcaaacgggtcctgctgctcggcggcatcctcgtcggacttttggcagcgaccctggccgccgtgtatttccttgacctcatgcccggcaagaaagcggccaaggacgccggccagactccggccgccgacaccgccgctccggctcccgacgcggccaagccggccgcccccggagccgacgccgccaagcccgcaacgcccggagcgccggcaggccagggcgcgcaaaagcccgaggaagcggccaaggtcaaggacatcatgctgcaaaacgtgcggcagtattacgtttccaacgaaaaggccggccagctcttcgtcatcgagggcaaggccgtcaacaacttcaagacgcccaaggaaatgctcaagctcgaagccagcctgttcgatgaaaagggcggcacgctggtttccaaggaagagctggccggcaacaccgtgtcgcttttccagctccaggtcatgacccgcgacgagctcaaaaacgccctggcctcccaagtcggcgtgctcaccaacaacaccaatatcgctccggctggcgaagtgcccttcatgatggtctttttcgatccgcccgaagcggtcaaggaattcggcgtcaaggtcgtggacgccaaggacccgccccggcagtaggatggcggccaagaccaagcgcaccttcgtctgcgccgaatgcggcggggcctcgcccacctggcgcggccagtgccctcgctgcggggcctggaacaccctggccgaaaagctcggcggaccagcccgaatccccggcccggacggcttgccgtccgggcttcccattgtgctgggcgaccatcccggcgcggatttcaagccgtttcccaccggcatcgacggcctggaccgggtgctcggcggggggctgaccccgggcggcgccgtgctccttggcggcgaacccggcatcggcaagtcaaccttgctgctgcagctggccggccttgccgccgccgccggccgccgggtggtctacgtctcgggcgaggaatccctgccccagctcaaatcccgggccgagcgcctgggcgtgctccacgacgggctgctcgccgcttccaccaccgacgccggcgcggctgtggacatcctgggcgcatctcccgccccggacctcgtcatcctcgactccgtccagaccatgcacgccgccggagtcgaaggcccagccggctcggtctcccaggtgcgggccgtggccgccgcctgcgtggaagcggccaagcgtggcgacgcctgtctgatcctggtcggccacgtcaccaaggacggccagatcgccggccccaagctcctggagcacatggtcgacacggtactctacctcgaaggcgagcgccgccacctctttcgcatcctgcgggtgctcaaaaaccgctacggccccaccgacgaactgctcgttatggaaatgcgcgaggccggtctgaatgaagtgcccgatccttcgacgttttttctcggcgaccgggacccggccgtgtccggttcggccgtggtcatggccatggaaggccggcggccttttgccgtggaagtccaggcccttgccgccaaatcctttctctccatgccgcgccgggcggccctcggcctcgacgtcggccggctccacctgctcctggccgtgctcgaaaaacgcctgcgcctgaatctcggccagaccgacatctacgccaagatcggcggcggcctcaaaatcgccgacccgggcctggacctcggcatcgccgccgctgtcctgtcctccttctacgaccggccgctgccggccggcgcggtcttctggggcgaagtcgacctgtccggccgcatccggccggccgccgcccacgatacccgcctcaaacaggctgaacgcctgggctacggccccatcatcagccccgacggcggcaagggccgccccaaagccgacaacctcggcgatctggcgcggttgttgttctcgtagtggataagagggggatgcctccggcggctgggggcctgaggcccccagaccccccaacggggtataggggagccgggtgtttgtggagatgcagtaacgtgcttcgacgctaatcatcgccaagcgtcatggcgcacagccattccaccggcgcgaattcgtccgtcaacatgaggcccccggccagggaggccgcttcctgtcgccggccgagaaatcggcgcagctcgtcgctgtggccttcgggcagggggccgggccggttgcgggccacgagcatcacgttctgagccgcctggggcgactcggggctgcccagggggtacagcccgacatccgggaagaccgaggcgaaggtggcggccagggaggcgataaaccggctgccgtcgccggccgccgggccgatagcgttgatgatgagcgcgccgtccggggccaagagcgcctggtaacgccgggccgcctcggccgtcaccagatgaaacggcggggcgtagtccgtgccgaaggcatcgagataaataaggtcgtaggggccgccgtcgcggttgacgaacatccgcgcgtcttcgtgaacgatgctcagcccaggccggggtgtcagcccgaaatattcctcggccagggccgttacccccgggtcgagctccaccaccgtgaccgcagcctcgggccgattgtcgaggaagtggcggggaaagctgtaagccccgccgccgatgaccagcaccttggcgttggccggggccatgtccaggccgatggtgaaaaaacgggtgtaactgagcgccagctcgcccggtgcgtccgggaacatggccgattggaaccgcgacggcccggtggtcatgacccggatgggccgcgtcgagaccgggtccaggccctggtagaccaacacccggccgtaaggcgtgtccacgtcgtggatgccggcctcggccaaaagggcgtcttgggcgtaaagccacaacccggccagggcgaccagcccggccgcagccgccttggccttgatcccggcgcgggtggcggccagggaaacgcaaacgagaaagccggccgtgaccagcaggatggtggtggagcccagggcggcaacgaggatgaagccggcggcaaaggtgccgacaatgctgccgcaggtggacagggcatagagccggccggcggttttgccggcattggccgtctggtcgaggctcaggcgaacggcaaagggcgaaaccatgccgagaagcccggccgccggggcgaaaaggagcagcgtggcggcgatgacgccaaatcgtggcccaaggccccgggtgaccagaaaatcgaggagcagcgccttggtggcggccgtggcggcggtcaacagcgcggccaggagaataatccgggccagcaccttggggtccgggcgacggtcggcgagccggccgccctgccagtaacccagggccagggcggccatgaccacgccgataagcccggtccagaccacgatggaggtacccagaaacggggcgaggatgcgcgctccgacgatttccagcaccatcaccgccgcgccgcaggaaaaaaccgtgaatgccagcatgcccgctccattcgctttgcgattgtctaccaccgtttacacttaccgatagccggcccaccccaagcccgtaaagggggcgcggatagtttttgaccggagccgttgtcctttgctaaagatatggactcactattttacccggcagggaggagcagcttatgaaacggttcgttgcggcgtttgcgggagcggtcatcacgttttccatggctggggcggccatggcgttttccggcggggcgggcatttccgccgatgaggcgctggcccgcctcaaggaaggcaacacccgctatgtggccggcgcggccgtgaccccgcgtcaggacgcggcccggcggcatgaaaccgccaccggcggccagcatccctttgtctcggtgctgtcctgcgccgattcccgcgtgcccgtggaaaccgtgttcgaccagggcattggcgatgtgttcgtgatccgcgtggccggcaacgtggccaacaccgacgagatcggtaccatcgaatacgggaccgaacacctgggcacccccctggtggtggtcctggcccacaccaaatgcggcgcggtcacggccgtggtcaagggcgagcatgtcaccgaaaacatcggcaagctcgtggcccccatcgtgccggccgtggcttcggtgaaaagccgctttgcctcgggcgacttgaacgagcttatcaaccgctccatcgaggccaacatgtggcaggccatcgccgacatgtacgccaaaagccccttgctcaagaagatggcggccgacggcaagatcaaggttgtgggcgcgctctatgacatcgattccggcgatgtccattggtttggcgagcatccgtccaacgccaaccttatcggcaagtagctgtcgtcatgatgtttctggcggctccttcggggccgccttttttttggacttttggacaaaaccccggtaggcccaaccccgtgcgtgccgtcgtcatcatcgtctttgtcgtggtctatgccgccatgatcctgggccgcctgcccggtctggccctggaccgggccggcgcggccgtactcggggctttggcccttatcgccgccggaaccatgaccgtcaccgatgcctgggccgccgccgacgtgccgaccctggccctgctcttcggactcatggtcatctccgcccagttgcgtctgggcggcttctacaccgccatcagccgcgcacttatcgccgcctcggccggcccggccggccttctggcccgggtcatggccgccgccgccacgctctcagcgcttctggccaacgacatcgtttgcttggccatgacgcccattttggttgaggccactctggcccggggcctcaaccccgttccgtacctgatcgggctggccatggccgccaacatcggttcggccgccacgctcatcggcaatccgcagaacatgcttatcggccaggtggccaatctgccctttggcggctacatgctggccgccctgccaagcgtggtcgccggcctggccatcgccttcgccgccgtggtctggggcttccgtggccggttcgccggccccaaggtgaccctggacgtgccggccccggcctattcgccctggcaatcggccaaagggctggccgccctgacggtctgcatgatcgttttcgtctggggcggcatggcccgggaaaacgtagccctgggctgcgccggggcgctgctgctcagccgccgcatggcctcgcgcgaaaccctcgccttggttgactggcaactcctgctccttttccttgggctttttgtggtcaaccgcgaggtggccgccgtgggcttgctcgacgacctttaccgaggcgtggccgcctgcggcgtggacctcggccggccggcctggctgttcacggcttcggttgtcctgtccaacattgtctccaacgtgccggcagtcatgctgctcctgcccggccatggctcgcccgaacaggcgaccttgctcgccgtctccagcaccctggccggcaatctgctgctgcccggcagcatcgccaacctcatcgtggccgatcaggccgcgctgcttggcgtctccatgggctttcgggaacacgcccgcatcgccgccccggccaccgtgttgacgctggtcgtctcgggctggttgttgttgggggtgtgagagaagaggggagatgcctccggcggctgggggcctgaggcccccagaccccccaattggggaatggaggggcgtcgggggtgagcgaggagtgacaacgtatggaagctattaaacgagctttggccgacggctggttccgggaacaggataccgctgtggtgctctacgacctggacgccctgacggcccgggtcgaggcgctgacaagcgcctttcccgccgaaaccgtccacgcctttgccgtcaaggcctgcccgctaccgccggtgttggccatgctggcccagctcggcctgggggccgaggcggcgtcccttggcgaaattcatctggccctggctgccggctttccgtccgagcgcatcgtcttcgactccccggccaagaccgtggaggagctgcgcctggccctatcccttgggcttttcgtcaatgccgacaacctggacgaactggaccgcctggacgacctggggcgggacatgggcctcgtgccccgggccgggctgcggatcaatccccaggccggaaccgggcgcatcaaggccaccagcgtggctgggcgctattccaagttcggcgttcccctgccccagcgtgaggccattgtcgacgccttcggccgctatccttggctttcgggcctccatgtccacatcggttcccagggctgccccctggaacttctcgtggccggcgtgggcgcggtttacgaccttgccgccgacctcgacgcccggttcggtccggggcgcgtggctgtcttcgatctcggcggcggccttcccgccgcctaccgcgacgcggaccgtccgcccagcccccaagcctacttcgaggcgctgcgtgtccgttgtcccggcctggagggaaaccagcgccggctggtcacggaattcggccgcatgatggccgcgccttgcgccgtggccgccagccgggtggaatacgtcaagcgccagccgggccatcgcacggcggtcatgcacctgggcgcggacatgttcgtacgcgaatgctacaacccgcgcttctggccccatcgcacccgtttgctcggcgcgcacggccttgagaaacaaggaaaacccgtgctgcaccatctggccgggccgttgtgtttttccggggattttcccgtgcgtcgggccatgttgcccgaggcaacggcgggggacatcgtggtcatcgaggatgtcggggcctacaccctgtccatgtggtcgcgctacaacagccggcaaatgccgcgtgtgctggggctgcggcaagggcatttttcggtgttgcgcgaacgggaggaacccgaggatctggtgcagttttggcttggcgggagcatgtcggcgtaaatccgggcgcactaccccgggcttgaggcaggcaggcgctacgctaaaggaattcgcctcaggccggagcgccgacggcctgggcgtcggccaggggccggcccaggagaaaggccacttcttcggaagtcagcaccgacatggacgggcggcatgggagctttccgggttgcggcaggcccagggcttgccaggtgcgggccagaagcgccccgggagacaaggggagccgacaaacgccctcctggtcgccagagaggcgttttgggctggggccatggagcagggtgatgatacggggggccagaccgtcaagctccttgagcagcgttgccgggtcttcgtcggcgtcaagggtcaggtaggccagttggcagggaccgaaatgagccgacaggcgcgccgcttcgtcggcgtcgcgggcggcgagcactgtgaaatgccccgacagggccccggtcaggaacgccagttccagggaatccgggcagacgatgagcacgcgggtaggcagggcaggcctcctcggacgccacgggaccggatcggcgtcacggggtttaccctgacaaatgcaaaaatcgatccagctcaaggattccgggcctgcggccgccacgccgggccgaggcggcaaatgctgccggattagcggcagttgccctcggccttgtagcttgtcaaaaagtcgcagtcgcccagatcgcaggctttcttatagtctgcgcaggcccgctcccggttaccaaggcgttcgtaggccagaccacgattggtaaaataggaggcgtccgacgccttggccgcgatggccttgtcgtaatcgggcagggcttcgcggggcttgccggcgttgctcaaaagattgccccgattgttgcgcaggtccgggtcctggggatcggcggcgatggcctcgtcgagcatggtcagcgcggtcttggtgtccccggcggcctgagccttggcggccagggcggccagggaagcggcggccttgggatcgcgagcgccgccggccggcacgggagcctgggccatggccggctgggcggtcggactcggagtcggcgtcaccatgggttggggaaccggcgcggccatgggctgcggggccggtgcgactgccgtttgcggggcaggcgaagccatgggctggggcacgggcgtggtcatggccggcgcgacaggcgcagctggcgccgcgggtttgggggctgcgacgggctgggaagccggcggcgtcgccgtggcagccggcggcgtcgccgtggcagccggctgtccggcgggttgcggcttggccccgaaaagcccggtcttgggctcgggatggggctggcgcacgggatcgggaatggacaatttttcggtcgcctggcgagacggaccggattccactccggaggtggcttcctgcatctgctcctggcgctgctgctcttcctggcggatggtgctgtcggcctggcgcatcttttccagacggcgcttgaggatttcctcttgggtcagggccgaggcggaagtggccgccaggacgagagacatggcgagaagcgaggagacaatccgtctcatggaacggtcctttgcaaaagccggcagcgcttagggcttggccgggatattgagcacttgcccgtcacgcagggtgtcgggatgcatgtcgccgttggcccgggtgatgtcttccacgctgacgccaaatttgtgggcgatgcgtgagagatggtccccgcgctgcacggtataggtcgtgccctcggatttcttgccgccctcggacttgcccttggcgtccttttccttcttgcctttctccggcttggccttgacggccggctcggccacgggagcgggaatctcgatgacttcctcgcccttaaacggcacggccagctgcttaccgtcgccgggacgcaccggggaaggggcattgggcgcaggagcggcggtcttggcggcaatcctggcgtcgtccttaaagaaagcggcgtattcgctttccgacaacccgccgtcgaaatcggcatccgatttggtgaacaggtccggggtcacgtccggaaaaacgaacagcagctcctcgtaggagatcttgccgtttttatcgtggtcgacatgccggaaggattccttgtcccctccggagcaggcgctgaccagggcgataagccccagggcaaccaaggcgatgactgaccgcataggctcctcgtatctggcgttggaaaggcggcgcatatgccggcattcgaagctggcgcttaccatgggggcaatcggcaagtcacgtgaaaaaaaagagggatttgttcatcccggtcggcccggccgggattgcggacttgccgactcccccgggccgggcgtaccacggcctgggaacgccggccgccagggccggccgtcccgggcatcaccgaatacgacgggaggctgtgatggatattgccacgcttcgaaagaccgccaaggaagaactcaagggctattgccgggtgtgcccggtttgcaacggccgggcctgcgccggcgaggccccgggcatgggcggcatgggcacgggctcggcctttacggccaacctggaggccctgtccaaggtccggctcaacatgcgcaccctgcataatgtcaagacggccgacaccactgtcgaactgtttggcaagaccttgtccatgccgatcctggccgcgcccatgaccggtgtgctctacaacatgggcgggcggttggccgaggacgaattcatccgccgcgtcatcgacggcgcggccgaggccggaaccattggcgcatgcggcgacggagccgatccggccatgttcgacagcggcctggccgccatcgccgccaaggccggccacggcatcccctttatcaaaccccgcgcccaggacgccatcatggcgctcctcaagcgctcggccgaggccggcgtggcggccgtgggcgtggacgtggacggcgcgggcctggccgtcatggccctgaagggccagccggtgtcgcccaagaccccggaagaactgcgggaactggtcggagccacgacaaccccctttatcgtcaagggcgtcatgaccccggacgaggccgaaatcgcctttgccgccggagcagccgccatcgtggtttccaaccacggcggccgggtgctcgaccataccccgggcgcggccgaggtgctgccggccattgcccgggccgtcaagggcaagggggtcatcctggccgacggcggcgtgcgcaccggagccgacgtgctcaagtacctggctctgggggccgacgccgtgctggtgggccgtcccctggtcatcggcgcgttcggcggcggggccgagggcgtggcgcttttgcttggtaaaatgcgggccgagctggccgcggccatgctcctgaccggcacggcctcggtgcgcgaggtgtcgccgcgcatcgtctcgttccagtcctgatccgggccggctgcggccggcgtatcgtgaaaagccccggccggtcgctcgcgcgaccggccggggcttttgttgctgtttggtgcagcgcctagccgtcgaggccaaggggcgcgtcgccgtctttccaggtaagttcaatggagagctttttcttggacttgccggacttggctttctccttgaagctgatttccagctcgcccaggcgcggcagctccacgcacaccggtccgttatcgccgtttgcggccagcttgccctgcttgaggccggcgacgattttctccagcacgacggcggcgtcgtaggtcagcattttttcatcgcagtggaagaggtcggttttctcgcccatggtgcgctcctttgcgggtctttttcagcgaaaccaacttttctcataaccactttgcgacaagatgtcatgacgggcgcgagaaattccggtcgcggcggcgagacgagggtcaagccggcaggacatgagacggattgacggccgtggagcgtcctgcggtcacatctggctggcgatgcgttttttccagagagaataggcgttcttggtcagatggatgccgtcttcggtgaaattggggccgagcttgccgtcgtcggccaggaaggcgtcatagaggtcgagataccgcacaaaggcgtttttgcggtcgcaaagggccttcaagcgttcgttggtggacacgatgacggcgttgtcgatgttctgggcccgggtgggcagaatgctttgcacgtagatgtgggtatacggcgagaggtgttggatcttattgatgattttgtcgtagttgtcgataatccggtccggggaggcgatctcgttgatgccgaccatgaggaagactttgcccggccgtttttgggcgataggctcaatgcggcgcagcagatcggcgctggtggaggactccacgccgctgatgaagaccttgcgcggttcttcgaaaagattgtagatttcccagcccttggtgatgctgtcgccgcaaaagacgatctgcatggcgagcagggcgggcagcacgggattcacggaatacgcctccggatgcgcggtcgctttcgggcagagttgccctgatcggcaaaaaataagcggcgtgacgaatccggtcaagggaagggccgccgggcatggcgccgtatggaaaacattgcgcccggcgcgcgcgaaggcgggccgggcgcaatgttcgaaaaaaactagcgttccagggcgatcaagtcgtcatagctctcgcggcggcgggccacgatgacctcgtcgccgtcgaccaggatttcggccgccctgggccgggagttgtagttggaggacatggtgaagccgtaggcgccggccgagaacacggccaggtgttcgcccggggccacggccggcaaagcccggtcccgggccaggaagtcgccggattcgcagatggggccgacaacatccacgctcagttcgggccggccggccgggcgcacttcgcggatggcgtggtaggagtcgtagagcgagggccggatgaggtcgttcatggccgcgtccacgatgatgaagtccttgctcggggtctttttggtgtagaccgcctcggtgaccaggatgccggcgttgccgacgatgacccggccgggttcgaggatgagcgtgatgggcagatcgcccagggccttggtcagggcctggccgaattcgctgggatgcggcggctcttcctcgttgtactggatgccaagtccgccgccgaggtcgaggtagcgggtctcaatgcccatggccgtgagcttgtcccggaaggccagaatcttgtccagggcttccaggaacggtgaaatggaggtgagctgggagccgatgtggcagtcgatgcccaccggcgtgaccccgggcagctccatggccttggcgtaggcggccagggagtggtcgatgtccaggccgaacttgtttttcttcagccccgtggaaatgtagggatgggtcttggggtccacgttgggattgatgcgaaggctcacttgcgccgtcttgcccaggcgcgaggcgatggcgcttaggcgttcgagttcgcccgtggactccacgttgaacatgaggatgccggctttaagcgcttcctcgatctcactggcccgcttgcccacgcccgagtagacgattttttgggggtcaacgcctgcggccaaagcccggtagagctcgccgcccgagacgatgtccatgcccgcgcccatggcggccagggttttgagcaccgacaggttggaattggccttgacggaatagcaggtgagatgcggcagagcggcaaaggccgagtcaaaggccctgaaatgccggcgcagggtggcggcgctgtagacgtacagcggcgtgccgtaggcggcgacaagggtcgaaaccggaacgtcctcggcgtacagctcgccgccgcggtactcgaaatgatgcatgggctggtctccttagcgggcgttgccgccaaatcgccctttccagtcgcaaagcagcgtcagggcttcaagcggcgtcatccggtctagttcgaggcgcgacagttcgtcaagaagtagggcggacaggtcgggccgggcctcggtttcgtccgctgcggcgtggggcggctgcacggcgaacagcccgggcagggacggctggccgcgctcgcggttgccccgggcggcctgggcggggtcgcggcagctttcgagttcgccaaggatctcccgggcgcgcttgaccacgtttcgcggcacgccggccaatttggccacttccacgccgtagctgcggtcggccggcccaggcagcagccggcgcaggaaaatgatgtcgcccttccattccttgaccgcgatgttggcgtttttgagccccgggatgcggccttccagggcggtcagctcgtggtagtgggtggcgaaaagggtgcgcacgccatggccgtcgtcgcggccgcacagttcctcgaccacggcccaggccagggccaaaccgtcgaaggtggccgtgccgcgcccgatctcatccaggatgaccaggctcttcttgccggcctgacgcaggatgcgggctgtttccatcatctccaccatgaaggtggactggccctgagccaggttgtccgaggccccgacccggcaaaaaacgcggtccaccagccccacgctggccttggccgccggcacgaaggagccgatctgggccaggatggcaatcagcgcggtctgacgcaggaccgtggatttgccggccatgttgggaccggtgatgagcagcatccgggtcgattcgtcgaggctcacgtcgttggggatgtagttgcccacgcccgtgacggcctcgaccacgggatggcggccagcccggatggcgatggcctggccggcgtggagttcgggccgggtccagtcgccggctacggccgcctcggccagtccttgccagacgtccaggcgggcaacccgggcggcggtttccatgacccgctcgcgcaatccggccacgtggtcgcgcagttcccggaaaagattgtattccagcgtcttgcgtttttcgccggaggccaggagcttgtcttcgagttctttgagcgccggggtgacgtagcgttcgcagttggccagggtctggcggcgctcgaagtgggccggggcgtagccggcagctttggacagctcgaaatagtagccaaagactcggttgaagccgagcttgagcttgggcagattgccgtcttcctgttcccgggccagcagttcctggagtttttgctcgccgtgttcggccagatcaagcagttcgtccagttcgggatgatagccggcccggaacagtcccccctcggtgacgagcaccggcggcgaatcgaccaaagccctggacaggagttcgaaaaggtcgtcgaggtcgtcccaacccgacagcagggcgctggcggccttggccgaggcggccccggacaggcgctggcgcaacgcgggcagggcggccagggattggcgcagggcggtgaaatcgcgcggcacggcccggccgaggaagatgcgggtaataagccgctccaggtcgtagaccccggccaggtcttcccggacaaggcggcgaaggctctcgtcctcggcgaaaagggccaccgcctcctgggtctcgtggatgggaccgaggtcgagccagggctggcgcagcatggtttccagcagccgtccgcccatgggcgtctgagtacggtccagtacatgccacagcgtcccccggcctttgcggccgtccaggcggcgaaaaatttccagattgcgctcggtgacctcgtccaggagcatgtgccggccgaggttgaccggcttgaatggccccaggtggccgagatcgcgcatgtaagtggcgcttaagtaggtcaaaagcgcgcccatggcccgcacgagctggggcttgtcggtgcagtcaagtgcggccagatcggccacggactgggcggagagcaccttgtcgcggccggcggcgaaatcgaaatggggccgtggcggcacggtggtgacgtggacgccggccagggggatgtcgcggggcggggtgacgccctcgggcaggagcagttcgcgagggccgatcttcaccatccactgccacaggcgggcagcgtcgcgggaatgcaggccggaccattcgccggtggagcagtcgacccaggccaggccgccggcccgttcgtcggcatcgtagtagagggcggccaggaagttgtgttccttggcccgcaggttgccgtcttccacggccgtgcccggggtgagcacccgggtgacggcccgtttgaccaggccctttgcctgccgcgggtcctcgatctggtcgcaaacggcgaccgaaaaccctttttcgagcagttcggccagatacccctcggcggcgtgatgcggcacaccgcacatggggatgggcgaatccgctccgggattgcgcgtggtgagggtgatttgcagttcgcgggccgcggtgatcgcgtcctcgaaaaacaattcgtagaaatcccccatgcggtagaacagcagcgcgtcagggtgctcggccttggcgcgcagatactgttcgagcatgggggtcatcttgaaatcccccacggcaggcaagggcgctcctggctaggcgtcggccttttggggttcgctggtcgcggccggggcggcggccggagccggagcgacggcggcgaagctcggaggcgtggccacggtggacttcttctgctgggccatctgcttttccagggcgttgaccttgttttgcaggctgcgcatgcccgaggccaaacggaccttctcggccaggaagtagagggtggcgaacaggccgccggccacgaagctcaggagcagcacgacgtagaagggcacgccgggagtctggacctgatagccgaaggcgccgagcttgagcagcagggcggtttcgaggatggcggtgttctgcacgaaaaacagcatgcagacgaagaagaaaaccagcaggaaaagcactttgatcacgcgcatcgaggcctccttgtcacgacgtgacggttgcgtggtaatccgaaaaaaacggtttgagccgatcaaaggtggacagcagcaattccggcatcacccgggtttcgccaaaaacggccatgaaagaggagtcgccgttccagcggggaacgagctggtagtggatatgggcggcgatgcccgaaccggcggcctcgcccaggttgagaccgatgtttatgccctggggccgcatgcagtcgctgatgacccgcgtgcaataggcgatgccccgggtcaattccacattttcttcgtcggtgagctgggtgatgcagctgacgtggcgaaaaggcgtgaccatgagatggccggaattgtagggaaatttattcatgatgacgaagccgtgccgccctcgggccaaaaccaagcgatcccggtcgccgtcggttttctcaggcaggcagaacacgcagccgtcgggtttgggtccaaggatatactccatgcgccagggcgcccacaacacttccatcaagacgactccgcgcgatccttatttcttgagatgggacgccacgaacaccagcgcttcctcgggactcgacacggcgcgcacgccctcgatgccgccgaagcatcccagggccgccaccggccggcccagcttgagcgccacgccgatttccgaaagggtgccggctcccccggccacggcgatgacggcgtcgccgtttttgaccaccagcacgttgcgggcgatgcccaggcccgtggccaccggcacgtccacataggggttggccgctcggacgtcgtcgcccggcaggatgcctatggtgtgaccgccggcttccctggccccctggcagacggcggtcatcactccgcccaggccgccgcagacgatttcgtacccggccctggccgccagttcgcccacccgccgagccgtctcgtactgggtggcgtcgcattggcccgaaccgatgaccgatacccgtccggggcgcgtcgtgtccatgtccgtcttgcttacacgcgtctttgtccaagagcaagggagccttagcaggcaggcgacaacttgacgccaaagggcttgaggcaacgggggcggcaggctaccataagcgaccatgttcacctttgaaccgaaaaatttccccatgtctcctggcgtttacctgatgaagggagcgcgcggcaaaattctctacgtcggcaaggcgaaaaacctgcgttcccgcctttcctcctactttcgaaacgacgccgggctgaccgtcaagaccgccgccctggtggccaaggtcgagggcgtggacgtgctcttgaccgcctcggaaaaagaggccctgctcctcgaatcgagcctgatcaaaaaacaccgcccgcgctacaacattgtcctgaaagacgacaagaactacattctcttcaagctcgacaagcgctcaccgtttcctcggctggcgtttacccgccgggtggagcgcgacggcgcggcctatttcgggcccttcacctcggccgccgccgccagggccacctggaaggagcttggccgggcctttcccctgcgcaaatgcggcgaccgggccatggccaaccgggtgcggccctgcctgtaccattccatcggccaatgtctggccccgtgcgtgctggccgtggaccccggggaatacgccgccctggtgcgccgggtggaggcctttttgaccggccgctcggccgaggtgctgcgcgctgttgagcatgagatggagcaggcggccgagtcgctggccttcgagaaggcggccgggctgcgcgatctgctgcgggccatgaaaaaaaccgtggaagggcaggccacggtcttgacccgcctgatcgacatcgacgtggtggggttggccgccgtgccgaccggggtcgggctttgcgtgctttttgtacgccagggccggctgctcgaccgcaagacgttcttttttccgggtgtgacggctgacgaggcccggggcgcggccgtcacggccatgctgcagttctatcggcccgagagcttcattccgccgcgcatcgtcgtgcccgacgtcttgacggccgccgaagccgccgggagcggggcgctggccgaggcggccgatccggcttcggccgaggcgggaagggccggctctgggccggccgatggccagacgtcgccgggttcctcggctgtggggcttgccgaggcaagaccggccgaagacgacccaagcgctccggcggcaatccccgtggccgacgaccggcaggaaaacggtggggacctgaccgagcgcctgtccgccacaaccaatgccgacgaggccggcgaagccgtggccgacagtctggccctggccgaaatcctggaggagcgccggggcggggccctgcgcctggggtcgccgcgcggccgcgaggagcgcaagcttttggccatggccgaggccaacgccggccgagccgccgaggaagcggccaaggcggccgaacgcgacctgctgccggccctggccaaggcctttggcttggcgcgcctttcccgcatcgaggccgtggacgtgtcgcacctgggcggcaagggcgtgcgcgtgggactggtcgtctttgaggagggcgcgcccaggaaaagcgactaccgcagctacggctttcccgaggccgaaggctcgtccgacgactatctggccctggccgcctttgccgccaaacgggccgaggccgggccgccctggccggatttgctgctcatcgacggcggcaaggggcagctggccgccgtggagcgcgcccttggccaagccggcgcgggcggggcttttgccctggcctccatcgccaagggggaccggcgctcccaaaacgaaatggaagacgtcattttcgtgccgggccgtaaaaatccgctcgggctgcggccggggtcgccggagctgctgttcctgcagcgggtgcgcgacacggtgcacgactattccatcggtaggcaacggctggcccgcaagaagacgggccttcgaagcgatctgctggccctgccgggcatcggccccaagacggcgcggctgttgtgggaggcttttggctccacggcggccatgcgggcggcctcggtggaagccgtgcgggagcgcactggtctggggccggccagggcggcgcaggtggttgcggccctgcaagcggtttcggattgatcatcgccccggtatctggcaaaatagtcaatccattttatccggagacgccatgccccttgcccaattcctgtccctggcccaggccatcgagcctcagcatcgctaccgtacggtctatgatgcggatttctccgtcctcgtgccgggcaaggaacacatcgaccaggacattcttgacgacttcggccgcatcgacttcgccggccgcaccgtgatcgatctcggctgcaatttcggctttttcaccttccaggccagacggcaaggcgcggcggccgtgaccggcgtggaccgcgaaccccgggtgctcgacggctgccggctgctgcaacggcatttcggcctggataacgtgggctttgcctgccacgacatcgacgacccggcctgctcgctgcttggccgcaagttcgacatcgccatgctggtggaatttatcggcaagacctttatcgtggaaaaccgggtggccccggccctggccttcctggaaaagctctcggaccgggaactcattgtctcggtgcaaaagatctactggatccgcaaggaactggggaccacgcccgaggccctgggccggctttatcccgaacgctacatacgtggcggcgatttcctgctgctcgactacgtacgcgacttcctggccccgcgctggcgcatggaacccatttcgcccatggccgagggctatgaaaagccgcgcaagttcctgcgtttcgtgccggcggcgggcgcatgagcgatcccacccgccgcgagaacatccggcccgggcaacgcgtggccatcgtgctcaagaaggatcagcgcaccggggcgctgactgaaggcgtggtgcgcgacctgctcaccaaggccccggtccacacccggggcatcaaggtgcggctgaccgacggccaagttggccgggtgcatcgcatcctcgactgaccgactgcaagccggccgccgtagccagggctggcatcaccggtcggccggaagcatcgtctgaccgacctcgatccggtcgccgaagcaggctggcatcatcggtcggccgtgggcatcgtctgcgtggctgaccgactgaccggacgatctactccgcccgccacaaggtctgcaccggggtaaaggcggcgtcgagttcggggctgatttccaccgccacctcgccgttttggcgcgacaggcgcacatgggccttgggatcaagaccagcgctttgggcctctccgtgccagcgagccacgtcggccgccacaatggcgtcaaagcctgcctcgggccgagacggggccgcgaaactcgataccgtcacccactcctgggacacgttgtttctccttgcgctttggccggcgtcagggcgctggcccgatgattattggcaatccctgtcgtgcaggggacaggccagggcaaaatcgttccaggccggcgtatgcggttccaggcggccgtcgccccggatgtggaccacgcgcgcgccccgggcgagaagttccggggcgatgcgtccggcccgacagcagcgcctggggtcttcctcggcgcacagcagggtcaagcgccaggcctgccgccagtactgcatgatccgctcgatgccgcgcacaaaggacaccgccgcctcgatgggcgtgccgaccggacgcgcgccgagttcccggcccatgtagacgtagcgcacgccccagagcccaagggacggctccaggagttccctggaaaactgcggcatgtagtgcgaggtcggggcgctgcgcacgtcgatgaccatgttgacgccctgacgggccagcaggcttaaaaacacgacccgctccaggccgccatgcccgatggtatggatgggcgggcgggccagcggcttggcggccatcccttagacctccccggtcagctcccggaaacggaagcagccgcgcaggtggtcgttgaccagtccggcggcctggagaaaagcgtagacgatggtggggccgacaaagccgaagccgcgcttcttgagatcgcggctcagggtttcggccaggggcgtcacggccggaacctgcttgatgtcgtcccagccgccgatgaccggcttgccgtccgtaaagccccagaggtaggcgtcgaacgagccgaaggcctcctgcacggccaggaaggcctgggcgtttttcacggacgccgccaccttggctttgttgcggatgatgccggcatcggccaggagccgggcctgatcggccgggccataggcggcgatgcgggccggatcgaagccttggtaggccgtgcggtagccttcccggcgtttgagcaccgtgagccacgacaggccggcctgggccccttcgaggatgagcagttcgaagagcgcccggtcgtcatggagcggcgcgccccattcctcgtcatggtagcgcacgtacagcggcaactccccgcaccagggacaccgaggcttgtcggcaacgtctatatgcatcctcattgtcctctgtcgggaacagggcgaaaagcaaaaacgctcaagccctgcaagcgtccatgattttctggcaacccacggtgatgcccctgaaaccatttggggggtctgggggcccgcggcccccagcggagaggtccaggagaggcagcgtctctcctggccgccggaggcattacaaccccaattcaccccagaccgcgtcgatgcgggccttggtggccgggtccatggccagggcgtcgggccagccccgggtatggccttcctcggggccttttttcgtggcgtcgatgcccatcttgccgccgaagcaggccatgggcgcgctgtggtccagggcgtccagcggcccgtccacgatgaccacgtcgcggcgcggatcgacgttgttgcccacgcgccaccagacttcggccgtgttttgcacgttgacctcggcatcgaccacgacgatgaacttggtgaacatcatctggcccaggccccagatggcgtacatgatcttgcgggtctggccggggtagcgcttgtcgatggagacgaagcagaagttgtggaacacgccttccacaggcaggctcatgtcggtgatttcgggcaactgctttttgatgagcggcaagaacaggcgctcggtggccttgcccatgtaggtgtcttccatgggcggctggccgaccagggtggccgggtagacggcgtccttgcggtgggtgatggccgtgacgtggaagaccgggtagtcgtcggccagggagtagtagccggtgtggtcgccaaacgggccttcgcgtcggcgctcgccgggttcgacgtagccttcgagcacgaactggctgttggccggaacctgcaagtccacggtcttgcactgcacgagttccacggccttctggcgcaggaagccggcgaagaggaattcgtcgatgtcgtcgggcaggggggcggtggcggcgtaggtgcaggccgggtccgggccgatggccacggcgacctcaaggcgcttgccgcgcttttcggccagccggtagtgggcggcgcagcctttgtggcgatgccagtgcatgccggtggtggtcttgtcgaagacctgcatccggtacatgccgacgttgcgtttgccggtctcggggtccttggtgatgaccaccgggaaggtgatgaacgggccggcgtcgccgggccaggtggtgagcaccggcaggatggacaggtccacggcgtcgccggtcaggaccacgtcctgacagggggcgctttgcacggtcttggggaagatgccggccattttggcgagcttgggcaacattttgagcttgtcgatgagcccttcgggcttttccatctccaacacgtcgtcgatgcgccggcccagggcgtcgaggtcctcggactccagggccaggttcatgcgcgggaaggacccgaaggcattggtcaccaccgggaagcgcgaacccttgggattttcgaagaaaagcgctgggcccacggccttggacacccggtcggtgacctcggcgatttccagatacgggtccagcggcgcggcaatgcgcctcagttcgccctttttgtccaaaagccgcaaaaattcctgcaaatccttgtacgccatgcgtgaacgctccgggtgtggtcgatccggcgtggccgccggtaagggcttttatacgcgaagccgcagccccgtaaagggccgggccgcgccggcgataagcggcgcgaaaagcccgccggcctcggccggggcaagcggcccgagatgcacgcagaccggcgcaagctcgcgtcggcccaggcgcacggcggccagggcggcgacgagcctctcgccggcctcgggacgctccagggacagccggtaactggcccggcccatggacagggaaaagattccggaaacccggccggcctcggccagccggccaaagagccgcaaggtgaacgcgcggccggaccgggtgaccaggccttcgctggcgtcgagaccgggaaacgcccagggaaggtagaccggccgtccgacctgagttggcagaaagggccgggccagacgcagcagttcccgcaggcgaccgtaaaggccggccgcttcgggggtggacgtcagccaatcgaaaaggcgttttcgggcagccagtggggccaggggcgcgtttgccccgggtgcatttggatcgggcgggattggcgcggcgaacaggtctggcccacgatgcagcaaggcttcaaagcgggagcgggtttcagccagggcggccaggagcaggaccggatcgtccacggccgagggcggcggggtgatgtcgcggaggagcagttccggctccagacgttcgatgcgaaacacgagttcccgtcccgggcttggttcgtggtccagggcggccagcagcttgtgaccggccaggttcacccagaacaggccctgggggccgggcgcgaggagccggccgcgcacgatctgcccgacttgcctgccgcgcttgaaggtttggggatcggagcggtcccggccgtcgccgccggacggcgtgccgccggaagtgccccccgagacgcgcatggatggagtgtcctttgctttagggcttgccggtcagttcgaagtaatcggcccggtcgatgcccggaaattcgaacaccaccggcgtgcaggtcccctcgcggataacgcgcagctggcagggtacggcagccccggccatgatgccgtatttggcggcgaagcgcggtccgggcggcatggagttgatgagggtgaaggtgtggacggccccgggtctgtagagcggctcgttcgtgatgggctggttgggcacgaactggaaggtcacggtcaggggcgggtagggcgtgggcacgccggccgtgggggattcgggctgccagggcttgacgtccacgaaggtggccgtgccagggtagctctcatagcggcaggggccgcctacgcgttcgggaccggcggcgcgggccagggcgggcaggcagataagagcgacaagagccgccgtgaacggaacaaggaagcaacggggcatggcgaacctcctttggaggctgttggcgacgggcgttatttggccaaaaggcgcaggtacagatcgccgcgcatggggccgatgcgccggcccatgcccttgaggcggatgggccggcccaccacgaaatccggcggcagggtgacttccaccatggtcggcttggtattgcccaggccatgtcggatgccgactcgtatgcgggtgccggggagcagactggcgctgggcagatgcacggtctgttcgtcgtcaagctgttttctaaagtatcccttgagattttccaggaaacccttggacatgtcaaaggatacggccttgtcgccccagctgaacgacatttcccgcgcgcccttggctgccacctttctagcggtgcgctgggggccgcttttcacttgccggtagatgtcctcaaagacctgacgggcaaaaggatccttgagcaggtcctggagcacttcctcgcggcggaaatagaacccggcgtcggcgttgtccttggaggccttggtgtaggcctgcttggcctttctctgctgctggcgcgccccggcctcggctcccggcggcggcgggggaggaggaggcggcgggccgccggggcgggaagtccgcgcgctcgcgcccggacccggcgacgccttggggccggcgcttttggcctcttcgcccggctgcctgtagccggccgtgtcgtcgcggtcggccagaaagtggcgcaggagcaggtaggcttcgtttaagcgctggaacttgcgtttggccgccggatcgtcgggatgcagatccgggtggagcttgaaggcgagcttgcgataggccgatttgacggcctcgatgtcgtcgcgggcggaaaccccgagcagggcgcgcgcctgatccaagcgcatggaatcctgtccgcccatggccgcgccgccttaagggttgtccggacaggtctcgaccagggcctcgggcacgtcggctccccggggccggcaaagtccccggctggtcagatagtcgcggccttgcctggcaaattcggcgtggggggcctgcatgttgatgcccgggcagtcctcggcggccatggcgtggctgtcggcgtcgatgatgttgccgcgaaagtacggccaggctcggcacacgtcgggacgggccggatgcaccgagcacccttgcgcataaaaaatgcaatagtcgtcgtcgccggtgaccagccgttgccggccgccgacgaactcggcatagcgcgaaagaaacgtctcgtggtcaagttttacgtggccggccagccgcgcaatgtcggcggcggacatgacgatgccgcccacgccctgacagcagtggccgcaacgttgacagacaaaggcggtgacggtcggcatttccacttcctatccccaaaggcggcggtattcaaccatggtgcaacgatcttccacgacaacgacgcccgtcggcgccagcatgacccgggcctcggggctggcgatgcccgtctgcatccagaagcaagctggcctgtgccccagggccagcacctcggcggcatggccggggcaggcctcgggggcacgaaacaaattgaccagatcaatgggttcgtcgatctcggccagggtcttgcgggccgggatgccccagacctcggcccgggccggatgcaccggaatgacccggaagccggcgtttaaaagaaagcgcccgaccatgtccacgtccgtgccgggacggtccttggccccgataagggcgatggtcttgcccggggcaagcagttccttgagcgtcgagtcggcgtagagcatcaggtctccgggtgttttcgtttgcggcaaaaaagtgtatcggcttggcggcatcactgcctggaggtcaaccgcaccatgtcggatcgcgccatagcccgcttaagcctggaccaggcccgcgccctttgggaaaacgaggacgtcttttccctgggcaaattggcccacgccgcccgactcgccctgcatcccgagccggtggtcacctacatcgtggaccgcaacatcaattataccaatatttgcgcctgcggctgccggttttgcgcctttttcaaggcccccggccagccgggcggctacgtgctttcgcccgaggaattggccgccaaggtggccgagaccgtagaactcggcggctggcagatcctgctccagggcgggatgcatcccgaactgcggttgggcttttacaccgacatgctgtccgggctgcgcaggcaattcccgagcgtggccgtgcacggcttctcgccgccggaaattgttttcctggccgaaatggaagggctgtccatagccgaggtcctggccgaactcaaggccgccggactggcctcactgcccggcggcggggcggaaatcctcgccgatcccattcgcagccacgtctcgcccaagaaatccccggccgacgcctggatcggcgtcatggccgaagcccacaaacagggccttcgctccaccgccaccatggtcatcggcctgggcgagaccatcgaacaccggctggaacacctgctgcgcatccgcgatctgcaagacaggactggcggcttcacggccttcattccctggactttccagcccggcaacacggccctgtccgtgcccgagacctcctcctgggaatacctgcgcacactggccctgtcgcggctgttcctggacaacgtgcccaacatccaggcctcctgggtgacccaaggccccatgatcggccagaccgcgctctatttcggggccaacgacttcggctccaccatgatcgaggaaaacgtggtggccgccgccggcgtccacttccgcatggaagaagaagagctgcgccggctggtggttaaggccggcttcgaacccgtgcgccgcaacatggactactcgcgccgcgaagggtgagggaatgggggagggagaaaagaggcctccggcggctgggggcctgaggcccccagacccccccacatggggaaaagcttaaaagggggccggattggccctttcttcggctggatcgtctcttttggcagatggcatttggctgcgccccattgtttcggtggtcgggggagtaaggtaaagcgatttatgggattagggcgttgccccggcgattgggttggccagagaccggaacgtgacagccgcccccttgccgagaatcgcagacccggcggcagttgcccttctggcttcccgctagggaaaaaagtaaatggttctggtttgttgccccgtgtaccgccaacgcgacggcaccgacgtttgaaattgttaaacgcaaacaggattccaaagggcggcagcccgttggccgccggaggctttccccctgcttactgctgccactgcctactccccgtgtgtcttccttcccttccgcgccgggcgggcgcttaagcccacgccgccgagcacggtcgcgccgccgaggagttggccggcgtttaaggtttcgtccaggatgagccaggaaagcaggcaggtgatgacggggatgaggttgataaatgccgccgccttggccgccggggcgttgcaaacgccgtagttgtacaggccgtaggccacgaaagtgacggccagtcccaggaaaaacacggccgccaccggcccgaaggtcaacttggccggcatgggcgcgaacaccagggccggcgaaaaaaaggccatgccgacaaagctctgggccgccgtgagatacagcggcttgtggcgcgccgccagtttcttgcaggtgatgatgtagcccacggcacagcacatggccaaaaattccaggaaattgccgaggatgggacgcggggcctgcggtccggcctcgccggccaggctcatgacggccaccccggccacggccaggagcaggccggtcatggcccggacttcaagtttttcttgaagaacgaaagaagcggccacggccgtcatcaccggcaacatggcggtgatcatgccggcctgggaagcctgggtcatggtcagggcctgggactcgaagatgaaatacaggcacggctcgcaaaaggccatgaagacgatgcccttccagtccgcccggccggcggcgaagccgcccatgcgcttccagatgagggcgaacacggccgaggccacggccatgcggcaaaagaccgccagcagcggcgaaaattcccgcatggcgatcttcatggcgataaaggagctgccccataaaatagaggcaccgaccagggcgaaaaaggccgcccaggacatttcgcggtttgtctgcgacacgatgggccttccttgcggcctgaacccggcgaaaatacgccggatgcgttggtcaaggcatccgggacgcgcccggacggaggctatgcccgccccggccgattattgcaaccccaacggagtggtatcacatgacgtttgaagcgctggaacgcctgcctgaatcggaaatgctcgcccgtcaggcgaccgtctgccagttgttggccgaaaccgccccccaggccggcgggttgctcgttttttcgcgcctggccatctattatctcaccggttcctgggccaacggcttgctctggctgccacttgaaggcgcgcccgtgcttctgtgccgcaagggccggcagcgggccgagctggagtcgccgctggccactatcgtgaactttcgctcctttggggacatcgcgcccctgtgcgagcaggccggcagcccgcttgccgccatctgcgccgccgagcaggccggcctgccctggaatctggccaatctcctgaccgcgcgcctgccgggcgtgaacttcgtttccggcgacgccgccctggccatggctcaggcctacaagtccgagtgggagctggccaagatgcgcctgtgcggggcgcgccacaacgaggggctgtatgcgcgcctgcccgggcgcatcaaacccggcatgaccgagcgcgagatcactggcgcgtgtttcgacgtcttttacgagcttggccaccagggccagttgcgcatgggcagctatggcgaggaaatctttctggggcacatcgcggtgggggattcggccaactaccccagcgtcttcaacgggccggtggggcttcgcggggcgcatccggccctgccctttttcggctacgccggcacggtctggaaaaaggggcaggtgctgaccatcgacaacggcttttccctggaaggctacagcacggacaagacgcagatctatttcgccggcaaggcttcggccatcccggatctggcccggcgcgggcatgacctgtgcgtggccgtgcaacaggccgtggccgagcgtctcgtgcccggggcgatcccgtcggagctttacgccttgtccctggagatggccgacaaggccggattgtcggaaggcttcatgggcctgggcgaaaaccaggtccggtttctgggccacggcatcgggctgaccatcgacggctggccggtgttggccaagggcttcgatcaaccccttcgggccggcatgaccttggccctggagcccaagttcggcatcccggacctgggcatggtcggggtcgagaacaccttcgaggtgacggaacagggcggccggtgcctcaccggccagagttacgagatcctctgcaccgactagcccatcccttcgccgtgggccggggccattccccgccccacggcggttctccccgcgctcccgccaaccgcccctgccccaccgccccccattcccccatttgggggggccgggggcctcaagcccccggcccccagaggcatcttatctgtttgttattacttagatcttctgctccaccttcccaaaacacggaatgcacagcgtctggccggcaaagcggcgggtgcgcgattccatgacggattcgccacaggcctggcagacgaggctggagaggatggctgcccggcgcggcgggggtgtttggggggcggttcgaaggaaaagactttcggggtcgctggccaggacgcgcgcggcgcattgccgggccagggccggcagtttcttacgggcggccgcgtcgccggtgttggcggcctggcgcacggcggcgaattcgggatcaacggcggccagggcatccgggcgcagaacaaggcgcaggccggcaccgtcggcgcggcggtggaaggtgaaggccgtcttgccgtagtcgcggtggacgaggttgcctttgccgaaggtgcagccgagcagggcctggatggcgtccacggcgcacatgtcggtttcgaccacggccacgatgtcctcgtcgccgtcccggccgcacacggcctggcccaggcgcgcggcctggatgccgatggccagccctgggcacatgtggccgtggtaatccaccgcccgggcggtcaacgctggcatatcggtgaagtcttgcaagggagggctcctaatgtgttgatatggaagatgaagatgcctccggcggccgggggctcagccccccggacccccgatatgggttaagggggcgaggagattacggcgtgttgttcgtgatgggaaacgtccggcccagagggccgaagtccttggccatatcggcgtagaccgggcggccgaccatgaaggcgtagaccgagtcggccttggcggccggatcgatgtcggcgaaggcctcgggatagagaatcgtgccggcggcgtaggcgtcggccacgatggtctctaagttggtcagatagctggtgaagggataaaccacgtagacccggccggcggccacggctggcaggctttgggcgaagtcgggctggccggacagttcctcggccatggcgtccagacccgaggcgtcgaggaacaggatgtcgggacgcagcgagagcagttgctccttgtcgagaaagccgtgtccttccttaaccagtttggcggcgacgttgtcggccccgagccagtccagcggcggatagggattgtcggtgctggtcaggccatgggagccgcgcatccctgtgccgccgacatacacgcccggccggacgtagcccggcgcggccagccccttggctgcccggtcgcgcacgtcggcctcggcggactgcaggaaatcggttacttccttggcccgagcttcccggccaagaatcacccccatcatggccagagtgtcgaacaccttgggatcgtagcgtccgaacgcgccgtagctgacgacgaccaccgggatgccgagcttgtccgaaagacgttgggccgtgccctgttccatggtcgaggcgaagatgacctccggggccacggccaagagcgcttccaggtcgggttccttgtcgatgctctgcgggccgcccgggccgatgaccggcagggctaaaagctcggggtgggccaggttgtagggacgtcccgtgcgccgggcggtctcgaagcgctcgatgccgaccacgcggtcggtggcctgaaggtaggcgataaggcgcagacagcccggtcccaggcagacgatgcgctttggcgcggccgggaccgtgaccgaccggccggcggcgtcggtgacggttcgggtttcgccggccaaggccgaaagggcggtagcgagcaggaccagcagacaggccagggcgaatagcgggcgaggcatgacgtctccttggctgaggggtttacgtcaggcggcgtcggccacgcccaggggcatgaccacgggatgaccgcccacttcgccaaaggccacctccacgccgtagacctcgcgcaccacttggggacctaggcccgagcggtccagcacggcatggacccggccccggcgcagcaacacaaagacgtcggcgaagcgcagggcctgggacaggtcgtggagaacgaccacggcggtcaggcctttcgcggcagcggcccggcgcacgatggctcggacgtcctcggtgtttttcaggtccaggctggcggtcggctcgtcgaggagcagcacgtccggctcctggaccatggcccgggcaatggacgttttttggagttccccgccggagaggtcctccaggcgtttgaaggcgagcggctccaggccaagggcggtcaggccgttttccacggcggccaggtcgcgccgcgacggaccaaggcccatatggggccggcggcccagcagcacggcctcgaatacggtgagactgtccggccgctgggactggggcacgtaagccacgcgccgggcgatctgccggcggcttacagcagccatgtcccggccgtccagggtgacccggccgcgcaaggggcggatcaaaccgcccaggcagcgcagcagggtggacttgcccgctccgttgaccccgagcacggcggtcaccagacccttttgcaggggcagatcgacgtttcgcagcacttcccggcggccgtggccgcaggcaacgtcgtgggcgcaaagcgtcatgtccgacctcctcgcaacagcagcaataaaaacagcggcgcgccgagaaacgaggtgagcacccccaccggcagcgcgcccgtgccggccagctgccggccggccgtgtcggcccccagcaacaacagcgcgccccacaagccgctatggagcaccagaggaccgtggtcggctccgaccagccgtcgggcgatgtgcggggcgagaagtcccagaaacgcgatgacgccgcaggccgcgaccaccacgccggtggccagggcggccagtcccagtccggccagacgcaagggcagggcgcgcacgcccacgcttcgggccacgtcctcgccggccagtagagcgttgaggtcgtggcgggccataaggccgaaaccgccggccgcgacgccagccccggccatggccgcgatttgctcccagccggcacgggacacgtcgccgaaggtccaatagacgatggcggcaagctgcaggtcgtcggcgaaaaactggatgaggatggtgccggcggtgaaaagcgaggacagggccacgccgcacaggatcatggcctggggcgaaagccgccgaagcgtggtcagtgcggcaataagcgccgttgctcccagcgccccgccaaaggcgcaagcggaaaccgtggccgccgcgccgatgcgcacgatctcagcggccgagccggctacggcgttggcggtaaatcctccggctccgaaaaggacgatgccgcaggccgcgccaaaagcggccgcgtggctgatgcccagggtaaacggcgaggccagcggattgccgagcaggctttgggtcagcgccccggacacggccagggcaaagccgccgctgacggcggccaggatgcgcggcagccggatgcccatgaccaccaccccggccggcccggctgcgctttggccgaacaggtggccggcgatctgggacagcgaaaggtcgtagcggccggcagtcagggcgtagccggccaaaagggccaggaggccgcccagccccagagccaggagcgtcttggcccgcgagagggccagatggttggcgaccagcgacgttgcggcggcaggagggttggacatcaaggtatcggtagcacgtctttatggttcgtgcaacaacaagggccgtttgtgctaattcatacgtttttattcgataaaaagactggcggcgtctgcggcgtggggtggagaggcacccagggcagattggggtgcggcgacgaccgtagcttggcctttacgtggccggttcaacgacgagcacggcccgcgtcgccgaggcttcggcctcgggcacggccaagggcaggcagacaagccggcagcggccgaccggggcctgcgataaatcaagaccttcgaggatgaggatgccggccgaaagcaagatgttgtggacgggataggcgggatcatccagaggttcgatgctcatggcgtcaaggccggctagcgcgacgcctcgggccgtcagttcccgggccagggccggcgttacggcggcgaagtcggccgggaaattcgggccggtgaaacggcgttcccgggaatttcgggtggcaaaaagcacggcctcgccgggccggggatcggctgcggccaggagttcggggccaaggcgcagggcctggccgcagtccaccaccacggccggcaggaaaaaggcctcggcaggatagtcgccggcccgcttaccgccagggaggaaatgggccggaaagtcgatatgggcggcggcgtgggcgctcatcgaccagacggcggcttcgcagccgtgggcggcctggtcgagaaacaggcggcgggtaaaaggcggatcgccgggcacggggggcgtcgcggtcaggggtagcgagatgtcgatgacacggcttggcatggcgctccttggccgatggcggggcaggggaaagcgggttgcaatcggatggaaacgtgccatttgtactttctttcacaaaaaggaaagcccctcaaaccgtacgcgggactttggctgggagcaaggccgactgaaccaataggttgcctgccgcagtttgcatcgcggctttcgatcgacaacgggcgctcccgctcgggaggccccgtggagccggcccggttcgatgccggcgaagcggaaaagtgtcgtgcctgtcttgcaacaggtcaaaaaaataaatggttttcgtctgttgcaaacgaagcgtcagaggcgcttatcatcgacgtgacacgaggccccttcgcctggacaacccgcgcggggaagacaggcgagaaacccaacaaaaaacgcccccgcgaggcgagggcgtttacttggcggcgatagttgcctgaaaaagctacttcgcggccacgtggcagccgttgttggagcagggagccacggacaggggcttttggcccttggccttgcgctccacgttgagcttcatgtggcagcccaggcagctgttgtcggcattcttgtcgtggaaggcgcggaagtaggacgtggcttcctggcggtccttcaggttgtcgtggcagccggcttcggcgcagccctggatctcacccttgccgtcccacatgtggtggcaggtgacgcaggctacggaagcgtgttggccgtgggaaaatttgaccggggcaaagctggtcttgaggaccccggacggccgtttgaaggtcagttcgagggggtagcacagggtggacttggcatccacgatgtcgctgaacttgccgccctcgcaataggccgccgtggccagggccaggctgcacaccataacgatcaacccggaaagcatgaccttggaacgcatccaactccctccttaagctccaagaaacggtgaaagtgaccttgccgctgcgactacgcaggcggggcgtcaggcaactgctccgccgccgtaattcagtggaaaagcgtaaaatttcacaagccggaagtcaatactcttttggcaaaaaacgctgtccgccagggtgaaagtcggcgcacgcacaatgcttttcaaaggattcacggggttaatcgttttcggtcaaacattcgagcttttccgatgcctccagggcgtccatgagctccaggctcaggcgaatgaagtccgaagcggtcagtatgccgacgagcttgcccccctcgaccacgggcaggcagccgtatttctgggtcagcagcacttcggcggcctggcgcaggggcaggtccggggtgaccatggccacgtcggcgcgcatgacttcgcccagcgggatgccggcgtagatgtcctcctgggtctgggcgtcgatctcggccagccgggacaccgaagcggcgagcaggtcgcggtgggtgacaagccccacaaaggccccggaaccgtcgatgatgggcagatggcggatgcgcgcctcttccatggtccgcttggcggacaacaggctgtcgtcgtggcgcaacgcgatgagatcctcggtcatgaggtcgcgagtagtcagcatgaacacctccttggtgatctgcgtgagttggcatcgaccaccggccgtgtcaaggcgcaaggcgttgacttgaggcggaaattctgttttccgaagaggattggaatggcgcggggaaggatgcttccccgtgaaaggaaactgatgaacgccactggggtcaagaccgatttgcggcgcagccgggaacgcatggtgcgggaacagatcgaggcccggggcgtgacccggcccgaggtgctgcgggccatgcgcaagacgccgcgccaccttttcgtcgaagaggcgctcattccccaggcctacgaggaccacccgctgcccatcggccacggccagaccatttcccagccctatgtcgtggcctggatgacggaactgcttgaggtcgccccgggccacaaggtcctggagatcggcacgggttcgggctatcaggccgccgtgctggccgaactcggcgccgaggtttataccgtggagcggataaagcccctctatgaacaggcccgggccaggctcgacgccttgcgctacgaccgggtgcagcttaaacttgacgacggcaccctgggctggcctgagaaggctccttttgatcgaatactggtggccgccggagggcccaagattccggccccgctggtggcccagctcggcccggccgggcgcatggtcataccggtggggacttcgcggcgaaaccagaccctgtgcctggtgcgccgggataacggccgggtcatcgtgcgcgatctcggcggggtcatgttcgtcgacctcgtcggaacccacggctggcaggcttcgtgaaggagttggctcaatgacgcaatccgattcctgtcgcggctgcaccggaccgggcaagccccttggggcggcgaccggcagcgacggccgccaagcccgcatcggccagaccttggagcgcatccgctacaagcttgtggtcatgagcggcaagggcggggtcggcaagagcaccgtggccgtcaacgtggcctgctcattggccgccggcggggccagggttgggcttttggacgtggatctccacggcccgagcgtgccgggcatgttgggcctgaccggcgccatgaccgccggcggcgaggcggccatcgcccccaaacgcttcggcgacaatctctccgtcgtctccatgcagtcgcttctggccgatcccgatgccgccgtgttgtggcgaggtcccatgaaaaccaccgccatacgccagttcatcgccgacgtggactggggcgacctcgactatctggtcatcgactccccgcccggagccggcgacgagcacctgaccgtgcttaagaccgtgcccgacgccctgtgcctgctggtgaccacgccccaggaggtctccctggccgacgtgcgcaaaagcatcaattttctccagtacaccaacgccaacatccttggcgtggtggaaaacatgagcgggctggcctgtccgcactgcggtcaggagatcgaacttttcaagaaaggcggcggcgaggccctggcccgggatttcggcctggagttcctcggcgcggtgccgctggacccggccacggtggcggccggcgacctgggccggccggtggcccttttgcccggggaccatccggccaaggccgcctttgccgccctggccgaccatgtggccgccgcctgccggggcagcctcgaagccgccgcctacccgaggccctaactggcggattgtcgagcggcccgcggcaatgcggaaatcgcccaggccgaaaatacgcccgttgcggcgcgttgcggggccgatggctgcggcgcgccgggcggaaggctttgacgccggcccggtattgctttaattgcctgcctgcgccacgaaaccaccagggactaaccacgctatgttcaatcttgctaacaacctcaccttggcccgcgtcggggctgtgccgatcctggtgctcctgctctattttccgagccggggagcctgttttgccgccatgatggtgttcatcgccgccgccgtcaccgacatcatggacggcgtggtggctaggcggtgcaatctggtcaccaatttcggcaagtttcttgatcccttggccgacaagctgctgataagcgccgcgctcatcatgctcgtccaactcggctgggtcgaggcctgggtggccgtggtcatcgtcggccgggagatcgccgtcaccgggcttcgggccatggccgtggaccacggcgtggtcatcgccgccgaccgctacggcaagctcaagaccgttttgcagatggtggccctgtgtccgctgctgctgcattatcccgtttggggtttcgaccccgcgccgctgggacagacgcttttgtacctggccctggttttgacccttgtttccggcgtcaattacttttatggattcagcaagcaggcgaagtggtcggacaaggccgcccggtagcgaagcggccatgcctcgcccgctgaccaacaccttttgcgacaaggcgctatgaaagccaaaaacatttccaagctggcccgtcgccgggtccgtcccgcccgggccggcctcggcaagggcgcctggtccgggacgcacctggacgacaatctcgccgcccgtatcgaaaactgcctgcacaccatcctggagctcgaacccgatctggagcgcctccagttcgggcattatctgctgcgcgacttcaaggtgctcaagatgtttctctcccaggtcgaagacatcgaagtggaggaacaggacgtgttgcgcatcgaggcggccaccgagaatttccttcgcgaactgaaggagcccctggcccagtccgataccaaacgcccgaagaaatacgtcgtgcaatgacatgatctggcgaaggttcctgctgacggcgctgatcttcttcaatgtgttcctgctctataatttgatatggagcgacaacggcatttttgcctacctcgaactcaaatccaggcatgagcagctcaagcaacgcctggaagccgtcaacgacaagtccttggacctcagccaggaaatccgctggctcaagaccgatcaggctttcaccgagaaaatggcccggtcccagatgaactacctcaaggataacgagatcctttaccagtttcccaaggacccgcccgccgccaaggagccggaacgggacaaggaaggaaagcgggccgatgctcagtaagatcgaaatctaccgggaagtcctggaaatcgagcccaactccaaggtcttcttccccctggcccgcagcctggccgaggaaggccgccacgacgaggccgccgccgtgctttcacgcggcatcggtttccatcccgaccacctcgaagccaagttcctgctcatcgaactccttacccggcagggcaaggaggagcaggccgatcaggtctttgccgacgtcggcgcgctgttggcgcgctatccctcggtctggctcctgtggtccaagaccgccgccgcccgggccaaggacccctccctggccatgctctttttggcccactacttccagaaccagaccctcacctgggccgaggtcatggagcgggggcttaaaagcctgagtcaggccgccggttcccttgagccgtccgaaggctcttccgggccgggaaccgccgaggcgtccggcggatcggagcagtcagggccggacggcggcgaagaagaagccgctgctgcgcagtcggcgagcattgcctcggacgtcgccgccgtgtctcaggatgccgtggcccccgccctgggtgataggccaggggtatcggaatcggccttgcttgagccgactggggaaatcgaggcggttcgtgagctgtcgcacgtcccttgcggtccggtcattcagactgccgccttgtccgaagccgagaacctgcccccggaaacgggccctgccccgtcggccattgccgctggtcctgtcgaagccgctggcccggagctgcgcggtgcccgcgaggtcatggagctggccggtctgctggacgctcctgaaaccgttgaaccccgtccccggtccaagcccgccaagggcaaggaacagggcgtgcgcacccggaccatggccgccgtcctggccgagcagggtgatctggccggcgcgcgcgccatttatcaggaactcctggccgccgccgcaaccgacgccgaacgcgaggagttgcgcgccctcatggacgccctgggcgcaacggggcggcccgcctcgcaggacccagtgcaaacgcccgccgccgctggccccaaatcggccaaccggctggctgattttctcgaagccctggccaaccgcctggaaacccgggccggatcgtaaccgccgccttcggctaaccgcctccaccgcatacgccaaccgcacgaggatacggctttgaaacgcaccgttctcgcggccattgccgccattgtctgtctttgcatccttgccggctgcggcaccatgaaaacccagtggcgcgaaacccgcaagctgtaccgggaatacatcaacaccgacccctccatcgacttcagcgaccagggcatctccgacaagggcctgcaacgcctggccgctctcatgatgcccgtggacgagcggctgctggccatgctgcgcaccctgggcagccaggacgcggccccggaccccgaatgggcccagcagctgctgtccgccaatgcctggctctccggcatcgccgtggtcgatgcttcgggagccatcgtcggccaggtgccttcgacgcccatgcgtccccttgactacgcgtccctgctcgacatggccgaccgctacaaggttcgcaagatgggcgcgcgcgtggtgtccgacgagatgggcacggtggtcatgatcgccatgccgtttttcaaggaaaacgaatgggccggtctggtcgtggtcaatttcgacccgcgtaacctggtgcgcttttctcccgaccccaatgcgctggtggtggtgtccaccgaaggcctgctctgggccggcggagccgggcagggcgagtccctggccgccctcaaatggagcgacatcctcaagggcgaggtgcaaggcgacatccggaccgggggcggcgaatacgtctggcaggcccgttacctcggccagttggagcttgtttatctcaccgacgcccgggaagtgcgcgccgccaaaccggaacccaagaaggaagccgcgcccgcgcccgaacccaacaaggcgctgccttccaccgagccgttgccgcagcctacggatctgaccactccctagacggccttctcgatgcatcgttggccggcggtcgaagccgccggcttttttttcttcccaaccctggaaaatcttgtgggtatttcggtctgggggtaggttgggacgaggccgcaaaacccgcgagccgcgccggggcctttgccgcccaggcttgaggagaacagccatgccgcagatcaccgtcaccgaacacctgctgttgcatcagaaagaatcccccatggcctcgggccgcttcacgcggctgctcaacgacctgatcctggccgccaagatcatctcccgggaagtcagcaaggcaggccttgtcgacgtgctgggctttaccggcgaggtcaacgtccagggcgagcaggtccaaaagctcgacgaatacgccaacaaggtgctgatccaccggatggagcgggccggggtgctgtgcgccatcgcctccgaggaaaacgccgacatcgtgcgtatccccgaccagttccccaagggcgattatttcctcatcttcgatcccctggacggctcctccaacattgacgccaacgtcaacgttggcaccatcttttccatctaccgcgtggccgaggggtgctccggcgacaagctgtgcgatctgctcatgcagggcgccaagcaggtggccgccggctacttcctctacggcacctccaccatgctcgtgtacaccaccggccggggcgtccatggcttcaccctggaccccagcgtcggcgagttcctgctgtcccaccccgacatccgcactccggagaccggcaaggtctattccgtcaacgaggcctactggtcctactgggacgagcccacccgcgagatcgtcagcgccttcaagggcacggacaacccgcgcggccagccctacggcggccgctacatcgggtcgctggtggccgacttccaccgcaatctcctctacggcggcattttcctctatcccgccgacacgcgcgaccccaaaaagcctcagggcaagctccgccttttgtgcgaggccaatcccctggcctttgtcatcgaacaggccggcggcgcggccaccgacggcgagcgcgacatcctgtccatcgaacccgaggagctgcatcaacgggtgccgctttttatcggtagcaaaaacgacgtggccaaggtcatggaaatctacggccgggccaggaaagcttaagcaacatgctttgtcttggcattgagacgtcctgcgacgagacggccgtggcgcttttcgaaaacggccgtcccgtcctggaaaaactcgcttcccaggccgatctccatgccgtcttcgggggcgtggtgccggagctggcctcgcgagagcatttgcgccgcctggggccgctgttgcaggcccttttcgccgcatccggacgaagccttgccgacgttgacgccattgccgtggctcgggggccgggcctgctcggcagcctgctggtggggctggccgcggccaaggggctgagcctggctacgggcaagccgctcattggcgtggaccatctccacgcccatctcctggccgcgaccatcggccgggacgtggcctttccggccctggggctcctggtttcgggcggccatacccagatcgtgcgcctggaatcggccctgtccctggaggtgctcggccgcaccctggacgacgccgccggcgaggcctttgacaaggccgccaagtcgttcaatctgccgtaccccggcggcgtctacatcgacgtgctgggccgggggatcgcgccggacaagacccttttcccgcgtccgttcctggataacgatcatttcgacttcagcttcagcggcctcaagaccgccgtggcgtcctatgccgccgcccatcccgaactgcgtgccggcagcctggccgaggcgggcggggccatcgaccccgaggcctggcccatggccttgcggcgggcctgttcttcgctcaatttcgccattgccgagacgctgcgcatcaagttcgagcgggccttggatcggcagcccggaccgccggccagcctcatcgccgctggcggcgtggccgccaacggtcccatccgggccatgctggccgatctggccgcccgacgcggcctgccgctctatttgcccgagccggccctttgcgccgacaacgccgtcatgatcgcggcggcaggcagccggctggccgaggcgggctatgcccatgacctggcgctgactgccgtcccccggggacgaaaggtgccctgggactatgccggcggaccgtccggcaaggcggcatcggttgacagcgcctcgccggcgcaataggttcgcacgattacggcccttgagtatgacggcaaacggcgcgacccgccgtcccgataacgccagaaacccgaccgccccggcggtcggccagaccatgaaaggagagcatccatggccatccaactgagcgacgccaacttcgaagccgaagccctgcagtgcgacctgcccgttctggtggatttctgggcgccctggtgcgggccgtgccgcgccatgggtccggtcatcgacgaactggccaacgagtacaccggccaggtcaaggtggccaagatgaacgtcgacgaaaacccgagcaccccgagcaagtacggcatccgcgccatccccaccctgatcctgttcaagggcggcgaagtggtggagcagatcaccggtgccgtgtccaaaagctcgatcaaggaaatgctctcccagaaggcgctctaatccatgaaacgattcgacgccgtcgtgatcgggggcggcccggccggcatcacggccgccctgtatctggcccggtccgacgtgtccgttgccatgatcgaaaagctctcgccgggcggccagatgctcatgacgcatctgattgagaactatccgggcttcccggatggcatcgagggctggaagctggccgacgccatggccgcccacctggggcattatgccgtcgagcgcatcaatgacgaggtcacggccatcgagtccgaaggcggactgcatcgcatccgcgttggcggcgaggtggtcgaggccaaggccgtggtgctgtgcaccggcgcgcgctacaagcgcgtcggcatccccggcgagcgcgaactggccggccggggcgtgtcctactgcgccctgtgcgacggcaatttcttcaggaaccagactgtggccgtcatcggcggcggcaactcggccctggaggaatcgctgtatctggcccggctggtgaaaaagctctacctgatccatcgtcgcgacgattttcgtggccagaaatgctttcaggatcgctgcttcacccatccggtcatcgaggtgttgcgttccacggtcgtgtgctccatttccggcggcgacgccgtcaccggcattgaggtccgcgacgtcaaatccggcgattgccgcaccatcccggtggacggcgtgttcgtgttcgtcggcttcgagcctcagggggatttctatccgccgggactcacccgcgacgaccagggattcatcctggccgacgacgagatgcgcaccagcatcgaaggcatctacgccgccggcgacatccggtccaagtcctgccgccaggtggccaccgccgtgggcgacggggccgtggccgcccacgccgcttacgcctacatcagtacgcggttcccgcaagactgatcatttccggacccgtgcgaccgcgccgcttcgaacggacggctgacgggtccggcattttttgcgttgtgccccttggggccatttggtaagaggacgcgcatcgagacgccgggttccgctgacgcctaccaaaggaacccgaccgccgcatggcgcccggccaggaccgggccataccgggaatataccatgaatgtgatgttgcgccgtttcctgcccttgggctttctgctcctgttccttggcggctgcgccggcatgatcgactactatttcctgccgccgcccgaggataccgcccaggaactctatgaggctggacggcagtccatggctgacaaggattactatggggccatcaattacttcatgaaattgaaggaccgctatccgtttagcccgtacacgcccatgggcacggttgccctgggcgacgcctacttcctcaccgaagattacggcatggccgctgaaacctataaggaattcgagtcggtccatccacgaagcgaagagattccctacgtgctttaccaagtcggcgtctccaacttcaagcgctccgaatccatcgacatgccgcaaagcaatctccaggaagccatccagtatttctacctcctggagcagaccttcccggataccgagtacggcaaggaagcggccgactacattcgtcgctgcaagaagcgcatggccgagcatgagctcttcgtggcagacttctactggcgcaccagccagtacggcgcggcctggaagcgctatatgtacacggtggagaactacaaggatcttgaggaagtgctcgaatacgccaagctgcgggccgagctgtcttaccttgaataccaaaagaccctgaccgaaaacgaacgccaggccattgaaggcagctggcgacactggaccaagcgctggttgtaaccatcgatctccggaagcttttcacttctggggccatacggcggcaaaacggggcggctggccgccccgtttgcgtttgccgcgcggggacttcatgaacgcgttgatgtccttgcccatgggccgttggcccgaagccttggaacgcgcccgcctggccgacgcggcctttgccgccgcctacgcccgcacgcccgaccgggagcgcgcctggatcaagaccggcctggccgccatgtacgcggccatgggcggccccctgccggcctccaggcagcgttgcgacgccctgggccatgacctgcttgcggcttctctcgatgtcccccaggattacgtgctcgtggcctgcggccgggatttcctgtctccggcccgcttgtccgccgtggtcatggccgccctgtgcgcccgcgtgcccgacgtggccgccgtgcgggtgggcgcggcctggcccaaaccgctaatcaccaccctggagctgtgcggcgtggaaacggccgcccggatctcccgccgcgactgggccggcctcctggccgagcttccggccaaggggcggggcgtcgtggtcctccttggcgagctgatcctgccggccggaatatcgcccggcctcgacgtccgccgggccgccgtggccggcaaagccggcgtgttcggccccggtttcgacgctgcagccctgtcctttgcccatccggattgcacgttttatagccatgatggccaatgtcccgagctgtccggctggcagacggggcagggaagcttggccgaagccggtcaggccgcctacgacgccgtctacgtgacggctgacgaggccttgaccctggctgccgacgcgccgctgtgcctggggccgggccgggagggcttctggctgtggccgcacttgccgcccgaggcctttcgccggcgccgcttcgccgctgtcgttgatcccaactgcgcggccgatgctccgacgcccggcccggaggacgcatgagctcgaagaaaggggcgaagaaaagccgtctggccagcctgcgcaacatcggcatcatcgcccatatcgacgccggcaagaccacgctcaccgagcgcatcctctatttttccggccgcatccaccgcatgggcgaggtccacgacggcaccgccaccatggatttcatgcccgaggagcaggaacgcggcatcaccatcacctcggcctgcaccacctgcgcctggaaagaccatcagatcaacatcatcgacaccccgggccatgtggatttcaccatcgaggtggagcgctcgcttcgggtgctcgacggcgcggtgggcgttttttgcgctgtctccggcgtggaaccccagtccgagacagtctggcggcagtccatggcctatggcgtgcccaagatcgccgtggtcaacaagctcgaccggcccggggccgatttcgaggcggccctggccgccatgcgcgaaaagctgcgcgccaatcccgtggccgtgactatccccctgggccaggggcctgagctgacggccatcatcaatctggccgccatggagcatgtccgtttttccagcgacggcgaggaggtttcacgccggccgctgaccgacgacgaagccgcctatgccgcgccctggcgcgagcgactggttgaagcggcctgcgactacgacgaggcgctcatggatgcctacctcggcggcgaggccattgccgccgccgccatcgaggccgccctgcgcctggggaccctggagcacaaggtcacgccggtcttcgccgcctcggcgctcaagaacatcggcgtccagccggttctcgacggcatcctggcctatctgccaagcccccttgaccgtggcggggcgcgcggcgtcgatcccgcttccaagaccgagatcgtttatccgcccgaggctgaggcgcccctggccgccctggccttcaaggtcagcatggagaccggccggcggcaggtgttcgtgcgcgtctattccggccgcctggaagccggcaaggacgtctggaacgccacgcgcggcgaaatcgagcggccagctaggctgtttcatcttcacgccggccaccgcgaaaaggccgagacggccggccccggcgagatcgtggccatcgctggcctgcgccgggcagccacgggcgacaccttgtgcgacaaggccagccccatcttgttggaggccatcggcggctacaagccggtcatcagcttggccctggagcccaaaaacgccgaagagaccgacaaactcaaggaagtcctggacaagctggccgaggaagacccgaccttgaccgtggcccacgaccccgacaccggccagatgattctttcgggcatgggcgaactccacctcgacgtggtgctggagcgggcccggcgcgaatacggcgtttcaccgcgcgccggcaagccgcaggtggtctatcaggagaccgtcgtggccgaggcggccggggagggcgtgttcgaccgcgaactcggcgaccgcagccatcacggccgggtgacggtggccgtatcgccgctgccccggggaaccggccgggaaatttccttcgagatcgaccgcctggcctatccgccggcctggagcgcggccatggccgaaggccttgaagacggcctgcaaagcggtcccttgggcggccatccggtccaggacgtgcgggtgcgggtgacgggcgtctttccggtcgagggcaagaccacggacatcggctgccgcatggccgccgcccaggcgctgaaaaacgccctggccgccgccaggccggccttgcttgaacctatcatggaactggagatcggcgttcccgacgccttcatcggcgacgtggccggcctgctcggctccaagggggccaagatcgagaacatggccgaccggggcggccacaagacggtcacggccttggctccgcttcgccggatgttcggcttttccaccgaccttcgctcggccacccagggccgggccggcatgtccatgcgttttctcaaattcgacctgctcgggtagtcgtacaggaacccatgtccacgcgcagcctggtttcgccggaggcgtccaagcgtttcgacgtcttgcgcaccctccttgtcgtcttcgtcatcggcatccacgccgaaaagggcttgcaggcctattacagcgccatgccagaagccctgaacgtctatctggccatttttccgcataacgtttttcgcctggccgtgccgcttttcttcgccgtctccggctacctcttctttttgacctacaagcccgacgccgcctcctacggccgcatgatcgtcaagaagaccaagagcatcctcgtgccctttctcatcttcaacgccatcaccctgatcctcatcaaggtcttcaacaaggtgccctacatcggcgactttcacgccatcgacgccgacggctacctgaaactcctcattggcatctaccgctatcccgtggtctacacgctgtggtttttgcgtgatctctacgtctatttcctgctggccccggtgttttacgtcttttccaaggaaatgcccctgaccggccttgtcgcctgctgggcggcctggatgttcctgccccaggggcgcattcccattgagctgagcggactggtctttttctacggcggctgcgtcctggcccggacccgggccgatctcgacggcctggcccgtttcgcctggccagtcggtcttggctatctggccctcatggccgtgacggcgacctatgagtgcctctacggctgccagtcctattatcacatcctctaccgcaacagcatgatcctgggcgtgttgaccgtctggcttgtttcagcctggccgccccttcgcgacgccgtgatgctgcgccggctggccgcgacttcctttttcgtgtatctgacccatgaacccgtattgtcgtacctcatctacggcacgcggtttgtcttcaaaccttcgggcacggtggtcggcatcgcctacatgctcctgctcaccgccctgacctacgccctctgccatggcctggcccggctcctggaacgctttgcccctcgggtctacgccgtggccacgggagcgagatagcgggccttgccgtctcctgcgcggcagggttgggtgaggacctttggatcgttgacgaggtcgcgggcacactgcctggcaaggggtttcggccaggctggccctggccaggaacgtgccaagtgtttcgaataacaatactccgttaagcttgttgtcgttccgagaaggaacttgcctttttcggacgcgacacgaggcgacgacaaggaagcgccatgcgcattatcggcggccgcctgggcggccgcgtcatcaaagtcattgactccccggggctgcggccggccacgggccgggtgcgggaagcgctgttttccatgcttgcggcccggggcgcgctttttcacggggcgagggtgcttgactgttatgccggagccggcagcgtgggcatcgaagctctgtcgcgcggcgcgggcaaggccgttttcatcgaacgcagcccggccgtggccaaggtgctcaaggagaacctgcgcggcctgggcctggggccggacgtggcccaggtcgtcgaggccgacgtggtcaaggccctgggccggctatccggcggctacttcgatctcatcgccatcgacccgccctatggccaggatctgctgccgccgaccctggccaaaatcgccgccctggacctcattgccccaggcggcattgtcgtggccgagatcgaggccggactcgacctgcccgagaccgccgtgccgcccgtgtttgactgcctgaccgaccggacctacggacaaacgaggatcatcctatggactcccagaaatcctgcatcgccgtctaccccggaaccttcgatcccctgaccaacggccacgtctctttggtgcgccgggcggccatgattttcggcacggtcatcgtggccgtggccggcgattcccacaagacgccgcttttcaccctggacgaacgggtggccattgccgagcaggtcttcgccaacgaccgccgggtgctggtggagggcttcaagggactgctcgtcaactacgtcaagtcgcgggaagccaacgtcatcctgcgcggcatgcgggcggtgtccgatttcgagttcgagttccagatggcgctcatgaaccgcaagctcgaccgcaccatcgagacggtcttcatcatgaccgactacaagtggctctacatcagctccaccatcgtcaaggaagtggccaagcacggcggcgacatacggggcatggtgcccgagcacgtacgcgagcggatgcttgagcgcttcggcccggcaaacgggagcggggagggcgcgtgagcgcgaggacaagggtggtttgtctggccggagccacgggcacgggcaagaccgccgcggccatcggcctggcccgggcttttggcggcgaagtcatcaacgtggactcgcgccaggtttaccaaagcctgccggtgctgaccgcccagccaaacgacggggagcgcgccgcctgtccgcaccacctctacggcgacacgccgctggatcagcccgtggcggccggcgatttcgccgtgcgggccagggcttgcgccgccgacatcgccgggcgcggccggctgccgctgttcgtcggcggcactggcctgtatttccgggccatcctcggcgggctggcccccatcccgcccgtgccggccgaggtgcgcgccgccgtcgccgctgactgggaccgcctggggccggccgccatgcacgcccgcctggccgagcgcgatcctgactacgcggccaagatcgccccggccgaccgccagcgcgtcacccgcgccctggaggttgaggccgcgaccggccgcgtcttttccgactggcaccgccaaggcgatcccgccgccccggattatgacgtcatcagcctcggtctggctctgcccctggaggagctggcccaccgactggcccggcgcatcgaagccatggccgccggcggcgccgtcgaggaagtgcgcgccgccctggaccgctatcctccggatgtcccgggcttaagcggcatcggcgggccggagctgacggcctatctttccggccgttgcggcctgggccaggccaagtccgcctggctgaccaacacccgcgcctatgccaagcggcaaagaacctggtttcgcaaggagccggacatcgtctggtttggcccgggcgacgaggccgggctgctggatttggtcgggaagcgtttggagggcggggcatgatggaccggcggcgcgtcctgtcgtttttggccgtggccggcggactggcttggctacggccttccgccctgttcgcggcttcggccgacgagttggccggggaagggcaggcggaactcaccggcggcaacgtggccaaggccctggtgctgctccatgaagccgagtccaaggacccgcgcaacgaccgggttcaggcgcttttgggccgggcgtatttccagcaaggcgacgcccggacagcactgacccatttcactcgggccgtgcggctcaatcccgaggacacgctgtcgcgcctgctggccgacaccatcagccagtttcccatgcccgccgccaaagtcgggtctgggcgcgaaccgtcgccttctcgttcccgcccctccagactggcccaggacgccaaggccgaacgcgaagccctggccaagggcgcagggaaatcaacccgacaagggccgtggcgcgtgctgctcgacgccggccacggcggcctggacgccggcgcggcggtcggtggactgcgtgaggctgacgtgaccctcgatctggccttgcgtttggcccgggcgctggccccggccagaaacgaggtgatcattcacctcacccgcaccgccgacgtgtccctgcccggctgggccagggccgggctggccggtttctacggcgcggacctgctcgtttcgctccatgccgcccgagtgagcgatccggcggccatgggcatcgcggcctatggctatggccgcgaaccgtccgatgcccaggccgcccttgtcgcccgagtcgagaacgccgcctacggaccaggcgcatcctggaaatcccggggcggggaagggcttttcctggctgctgccaataatgccgtgggacaggaccggttcgcgcgcggcctggaactggcccgcgccttcatgcgtgccatgcccgccgccgcgccgctgccaacgcgcgtcgccggatcagcccccctcaaactgctcgaagaagccgacgcgccggcactcctcttggagacaggctttctgtccaacgccgacgacgccgccgccctgggcagccccgacaagcgccaagccctggcccaggccctggccgacgcctttctggcggcgctgcggggagtgaagatgcctccggcggccgggagggggtaaccccctcccggaccctccctgcctgggggcgcgtcttccccttgaggcggagcctcaaggggaagacgcgcccccaaacaagaaggacaggcgggaaaacggcgcagaccgcaaaccaattgggggggccgggggcctcttaaaatgatgcacgcaaaaaagccccggggagacggctcctcggggctttgacggcggatgggatgttgctctaggctttgtggtccgtggagtcgtccttgggcttgcccggggtcacgtcgatctcgtcaggctcgttggtggcctttttgaagttcttgatggccttgcccatgccggcgccgatctcgggaagcttgttggctccgaaaataatgagcacgatgaccaggatgatgataagctccggaaatccgattccaaacatgctgcgcctccgctggtggattggccgtggctatacacgcggccttggggcaggtcaaggaaggcacggttttatggacatatcgtcatgacggcgcaagtgcgtcgcttgcccggccagggttgcccccattgccgggcagagcgctgtctctacgaggagcatctcaacccaggcctgcacgagaaccatcgttgcgccgtgcttaaccggctgtgccgtgcctttgacgacttcgtgctgcgcgccgacgtcatggggctgcccgacgagcaggcccaggccctttgggagagccgttttccggccaccctggccaaagaagggaattgtcaggattacctgcccggtgatacgacttccttcccggattgcgcccatgccgtgggcgatttgtgcttgctcgcctttcccctgtgcccggggcgttgtccacgctacctggaaggttgggcgcggggtgtcgcgccaaaggatggtttccatgactgacgcttccggcaacgccttgacgttgctgcactttccttgtttgactccggccgtgtccagtgacggcgtgccgggcgtacgttttcttgatcccggcctgggcgagcctggcgacccggagttgctgcgtcccgccgacctgccgctttcccaggaagaactggcgggatttttgcgcgaattcgagcgcctgcgccgcgagacgaaaaatcccaaggatctggcgttgctggccggagcgggcggagggcatttcttcagcgaaacctcctttgccgtgcgcgaggctttagaagaccagctcaatccgggccgggtggccctgcgccgggccaagcaggctcagctggccttgtgtctggccgccatgatcgagcacagcgtgctggagctggccgaggccggttccctggatgaggacttccgcaaagatctggccgagagccttggcattgaagacggcgacgacgatgacgacacggccatggtgctggcggcggccttttccagcgacggcggcctgccgaccccggcgaccctggccgacgaatttcgtccgccctggcgacagttgctgtcgccgttttgggccatagccccagtggaaaccgggctttttatcgatgatcctgaaatcgccgcgacactccaggacgctgatctcggctttgacgacgtcgcccccgaagcgtttccggccttgttccccggcggctctcccgatgcgccgctgatcgcggcccgcccgtccggttaccggttggccggccggacccggcccgaccctgaggccccgtggctcgacatgacgcggctggttgtggccgtcaaaccttaagacggagaagaaggccgcccgatgtacgtttgcaaccccgcttccccgcccgaattcctggcccggatttccggcgtcatcttcgactgcgacggcgtgctggtggattcccgggacgccaaccgcatgtattacaacctcatccgcgagggcatcggcatgttgcccatcacccccgaggaagaggactatgtccacatgcacgccgtgggcgagtgtctggaccgcatcatcccggccgagcgtcgggaagaagccgaggaagtccggcgcaatctcgattaccgggacatctttccgtatattttcctggaggatggcctggtcgagctgctcgaaaccttggaaggccttggtgtgcgcatggctgtgcacaccaaccggacgagcacggtggagctgctcttagctcattttgagatcgatcgttttttttcgccggtcattgccgccggagcgctcaagcggcccaagcccgaccccgagggcgtccaccgcatcctggctgactggcagtgccccaaggacgctgtggcctacatcggcgactcggccctggacgagcgttcggccgccgccgccggcatcgctttttggtcctacaaaaaccccggcttggctgcggccatgcacctgccggactttgacagcctgcgtgtttgtctttccggtttggcggcgaaataaccgcctgggggcaaacatcgtgcccgtgcccggcaggcccgagcctgcctcgccagcgaagccggcgtgcggccttggcaaggaaccggatttgtcttgattaatggccggcgctgtgccatttttcaggtaaagcgcgtctgcttttgatacgcgctggaaaggaattcgcatggatatcattggctatttctttgtcgccctggccagggtgctcgatattgtctttagcctctatttctggatcatcctgattgccgcgctactctcctgggtgcgccccgatccgtacaatcccgtggtccgtttcctgcgcgccgtcaccgatccggtattctaccgcgtccggcgctggctgccgtttctcaccatcggcggcatcgacctgtcgcccatcgtggtgatcctggggctgcagttccttcaatggttccttgtgcccaccctcatgcgccttggcggcgtggggatggggcgcatgtaggaacggcgcatggcgacggctggtccggcgtgcgccgcaaaccgcctcgggacggctaacgccgccgccgggctggaagcgtagccgtgaccctggataagatcgacctgctcgaccgcaccttttcccacagtctcgtcggctaccgccgcgacgaagtggaccgcctcgtggccgaggcggcggattccatcggccgtttggccgaggaaaagatggcgcttacccgggccaacgacggccttgcccgggaaatcgccgagtatcgcgcccgcgaggcgacgcttcgcgacacgttgctcaccactcagcgcatcgtggaggagctcaagggcaaggcccgcgaagaagcccggcgcatcgtcgaggctgcgcaaaacgaagcttccgccatagtggccgaggcgcgtggccgggccgacgccctggccgacgagatcgagaccctggaggcccgcaaggcggacatagccggccggtttcgcaatatgctgacggcggctttggccttgctggacaccgaggcggccgaggaggcaatccgggacgcgtcggctctgacaggtcggatggccgcaagcgatcaggaggcggccggggacgaaccccagggcctgccggtcggactggcccggttggccgaagggtctctggatgctgccgaaaacggcgtgtttcttggtggcgaggcggccgacgcggccgtttccttgtcgccgccggggcaggggggctaggcatggcccgccaagcctccgcccagtgtgtttccccggccaccggacctgcgtccggcgacgccgatcggccggttttcgtcgcgccggccggcgacggggcctggacgttgcgggtggccgtgacccccggaggggccaaggacgccctggccgggttggctgaagaccgccttcgggtacggctgcgagccaaggccgtagaagggcaggccaacgccgccctgaccgatttcgtggcgcgctgcctgggggtcaaaccccggcaagtgcgcattatttccggcgagaaatcccggaaaaagaccttacgtatcgagacagagtccgagcccgactggcccagggcggccgggacgggatgcgactagaaccgtcaacaaggagtctgtgccatggatcaacgcgatctggatctcgtcgccaagtacggtgaagcggacccggaactcaagagcctctatgaagagcatgtcgcgtttgaaaagattctggagaagatggagtccaagccgtatctgactccggcggaagagacggaactcaaggagatcaagaagaagaagctctccggcaagactcgcatcgaagcgcttttggccaagtaccgtaaggcggaggtccaatagcatggaacttaccggggcccagatcctcctggaatccctgcgccgtgaaggcgtggaagtcgtgttcggctttccgggcggtgcggtcatcgacatttacgaccagttgccgcactaccccctgcgccacgtgctggtgcgccacgaacagggcgccatccacgcggccgacggttatgcccgggccacgggcaaggtaggcgtatgtctggtaacctcgggccccggagccaccaataccgtgaccggcatcgcaacggcctacatggattcggtgccggtcgtcatcatcaccggacaggtgccgacgccgctcatcggcaacgacgccttccaggaagtcgacatcgtcggcatcacgcgctcctgcaccaagcataattatctggtcaaggacgtgcgcgaactggcccgggtcatcaaggaggccttctacctggcctccaccggccggccgggaccggtgctcattgatctgcccaaggacgtgcagacccagcttacggaatacaagtatcccaagaccatcaaaatgcgcagctacaaccccacctacgcccccaaccccaagcaggtggccaaggtggcggaagtgttgcgcaaggccaaaaagcccatcatctacgccggcggcggggtcattgcctccgaggccagcgacgatctggcctggctggcccgtgccctggacattccggtcacggccacgctcatggccctgggctgctttccggccgacgacccgcgctggctggggatgctcggcatgcatggcacctatgccgccaacatggccatcagccacgccgacctgatcctggccataggcagccgcttcgacgaccgggtcaccggcaagatcagcgagttcgccaaaaacgccaagatcgtgcatatcgacatcgaccccacctccatccagaaaaatgtggccgtgcacattccggtggtggccgactgcaaaagctttttaaccgccctgcgcgacatcctggagccggccctggcggccgaaccggccgcgccccatgaggcctggacgaccaaggtcacggactggaaagccgaaaagccgctgagctacgcccaggatgaaacgaccatcaagccgcagttcgtggtggagaccatctccaagctgaccaagggcgaggccgtcattaccacggaagtggggcaaaaccagatgtgggcggcccagttctacgccttcacccggccccggtcgtttatcagctccggcggtcttggcaccatgggcttcgggttcccggcggccatcggggcccagatggcctttccggacaggctcgtcatcgacgtggccggcgacggctccatccagatgtgcatccaggagctggccacggccgtgtgctacggcctgccggtcaagatcgtcattttaaacaacggctatctcggcatggtccggcagtggcaggaacttttctacaagaaaaactactgcgccacctgcctggacgtggccccggacttcgtcaagctggccgaggcctacggcgcggccggattcagggtcaccgacccggccaaggtcgagtccaccctggccgaggcctttgccctgccgcgtccggtcatcgtggacgtggtggtggaccgcgaggagaacgtggcccccatggtgccggccggcaagtccataaccgagatgatcctcgtctaggagagcacccccatgcgccacattttatcaatcctcgtcgagaacgaacccggggtgcttgccagggtggccggcctgttcagcggccggggctacaacatcgaaaccttaaacgtcgcccccaccctgaccgaggggctgtccatgatgaccatcaccaccaccggtgatgaggccatcatcgaacagatcgtcaagcagctgcgcaagctcgtcaccaccctcaaggtcgttgacctcaccgaggtcaagtccgtgcagcgtgaaatgatgctgctgcgggtggacgccgaaggccaaaagcgcgtcgaggtgctgcgcatcgtggacatcttccgctgcaaggtggtggacgtgagcccggacgagctggtgctcgaagtcaccggcaaccaggagaagctcacagcgcttataaacctcctgcaacgcatcggcatcaaggaagtcgcccgcaccggggccgtggccatgaagcgcgggatgcaggagtagggcgctgatgcgccccgtccgtattggaaatcgagcgtgccccaagcggcacgagaaaggagcaaggatgaaaatctattacgaccaggacgccgatctttccctcttggctgacaagaccgtggccatcatcggctacggcagccagggccatgcccatgcccagaacctgcgggattccggcgtcaaggtagtcattggccagcgccccggcggccccaactgggagcttgccaaggaaaacggcttcacccccatgagcgccgccgaagccgctgccgccgccgacctgatcatgatcctggtgccggaccagcaccagaaagccgtctacgagaaagacgtcctgccgcacctcaagcccggcaagatgctgcttttcgcccacggcttcaatatccacttccagcagatcgtgcccccggccgacgtggacgtggccatggtcgcgcccaagggtccgggccatctggtgcgccgggtctacaccgaaggagccggcgttccctgcctcatcgccatccaccaaaacgccaccggcaaggccatggagaccgccctggcctacgccaagggcgtgggcggcacacgcggcggcgtgttgaccaccacgtttaaggaagagaccgagaccgacctgttcggcgagcaggccgtcctgtgcggcggcgcggccgagctggtcaaggccggattcgagaccctgtgcgaggccggctaccagcccgagatcgcctacttcgagtgcctgcatgagctcaagctcatcgtggacctcatgtatgaaggcggcttgtcgcgtatgcgttactccatcagcgacactgccgaatacggcgactatgtcagcggcccccgggtcgtcaccgacgagacccgggctgagatgcgccagatcctcaaggaaatccaggacggcaccttcgcccgcgacttcatcatggagaacatgtccggacgggcccacttcctgtccatgcgccgcatcaacgccgagcaccccatcgagaaggtcggggccaagctgcgcggcatgatgagctggctcaagaagtagcttcacgagcggccggtcccgccggggccggccgctttttcaaggagacgccatgcccaattcccgtgggaattcccgaccgggccgttgcggcctgcgactatggggcgtcctgaccctgcttgctctgttttgggccgcccctgcctgtccgtccctggccgccacgaccgccgattcccaggacaatcccctcgaacttgccgctgacccgatccccggccagatggaacaggccgagaacggcaatcccaaggcccagtgcgacgtcggcatcgcctacttgaacggtcgtcatgtggcccaggattaccgcctggggctccactggctgaccaaatcctcggacgccggctttgcctacgcccgcttcgtcctggccgacgtctacaaccggggctacgccggcgtgccggtcaatgaggaattggcctattattacgcctccctggccgccgcttcctcgaccctgccggaccgggtccgcgaccgggccgtcaaattgcgcgacaccgcggccaagcgcttaagcgccgcccagatcaccgggatgcaggccaaagccgccctggcccctctggacgcggctgttggcaattgacgtctgctgccagcgcggactctccggccaacacgagcagcatcgtgcatgacctccatactcccaggtcctttgttacggctgcatgttcagcaggcctgattctttggcctggctcacccgccggccggtgcggccatgcggctcatcgtcaatcccggtcccggttcttcatcgtcgtcgcggcggtcctggcaatgctgtttctgaccgcgccccaggccttttgtgccgccaaggccgacaccaaggcgttcaacgcctactacgccagccagagcgcccgtatctacgaccatctgctcaaggtcacggactactacgcctccctggccaaggacggcaacgatgaccgcataaaggacgttctggcccttcgcgcctcgctttcggcttgctgggagctcattttaaacgccggcgacatggtctacgtctatgatatgctcgatcccggctgttcctcggcagtccatcagctaggcggcatgatcaagacagggctggtgaccgttggcggcaagctcgacaaggaactgcagtggatgcggctggtggaaaaaaatgtttccgacctgcccattgccgtgcaactgggccaagccttccgcgacattgaagccatggccgcctatttccgcaccgccgctccgactttcgagccggcggcagccggcgaaacccggcagtcggtaaagaaataggacgccgccatggccggatcgttcgaatgggtggggtatctcgccggtttgtgcaccacgctggctttcgcgcctcaggtggtcaagaccctgcgacgtcgttcagctgccgacatttcgaccggcatgtacgtgctcatgtgcaccgggaccgtgctgtggttgttgcatggcatcgacatcggttcctggcccgtcattgcggccaatgcggtaacacttgggttggtggtcgccatgctcgtcatggcgctgcgatacaaataacgccgcgatgatcgcggttcggaggacgccatgcgccgcctgacgcttcttttttgcctcgtgctggccgccgtgtcgtttggctgcgcccacacctatcaagtcgaaaccatggaccataagacgttctacgcttcgccgccattggtcatggacgctgaacgcggcgtttactacatgtggatcaacggcaaacgccaggtcattcccatggaccaagtctaccgcatcgactccagcgcccaaatctgttatcaaaatggcttgaccgacaccttcacctgttacgacaacctctattacttctagcggaacagcggatggctggcgacgatctgcccgcactggcgctgcgcctgctggagcgccagccgcctcccgggccgatgatcgccccggaactgttggttccgggtacgttgcctgaccttgtcgatgccctgggccggccggaaacgccggcccatccggcgcttttggcaagtctcgtcctcaaatacgcccatgcctacgtccatcccgaacgattgggtgaggacgtctccctggccgacctgaccgagctggccggccgtttcgtgcgtcggcggggcggatcggcccttcttgccggacaacatgcgctacgccggttccttttgcatcacggctttgccttgcagatgcttcttgacctgcccaagaccgtgcacttgctgaccgcgcttttggccgccaaccccgacgtatccggtcgttttctcggtctcgactgcggcgcaggcacgggcattttgctgcttggcacgtatctgctggcccgtcggcatggcgtagccgcgccgacgctgatgggtgtcgaggtacagccccaggtggcggcccgggccgacgcgttgctttcgagccttggcgtcgggcgggtgcgtcaggccgacgccacccggcccgagacctatgccgccctgccggaaggtcccgtggcctgcctggccaacgagaccctgccctcggccggccgccggctgtacaaggaaccctttccggccataagcgcagcgcttttcgcggcgcttgggccgcgcttatcgcgcacggtttttttgccggaagcggtctgggcctcggaccgacccggccgggagtggctgcggctggccccggaaaacgcctttgccggcgacgcgggcggccatgccaaacctttgcgtctggcgtttatgcgcgatgtggagctggctggtcagcgtgtaccggtggagcgtgtcggggaagggctggcctggctcgtggccgaaccgtggcgcgaagcgctttgccggcgctggtagctgtgggaacacggccggccgctcgccggaagattccgggaagaccttgccggcgggctggagcgttgcggacgtccgcgccgtcgacagcttgtctatgtcgccgacaaacggacgcgcgctcttggagggaagggccgccgcgagtggttgaagcggcaggggctagagcgtcagttcgtagtaccgcgcctcttcgaagggattgtcgcagtacggcccgatctgctcaaacccgagcttgcgatagagggcgttggcggcggtcatggatttgagggtgtcgaggcgcatgacccggtaaccgcgtttcctcgcgccggccaaggccgcttcggccaagcctcgacccagaccgtggccggcgtggtcgggtcgaacgtagagccgcttcatttcacacaccccgtcttccaggggccgaagccccacgcagccggctggcagtccattcacccaggccagccacaggccgccgccaggcacgccgtagcgtccgggcagaccggccagttcctcgtcaaaattctggaagcacagagaaaagcccagccccttggcgtattcttcgaacaggatgcgcaccacggccatgtccgtggccggcgcaatgcccgaggcctgccgcaacgattccagagatgggcggggctgcatcatggtgttcttccggcgacatgttctgtcatgcggtagtctggcgctccgaggtcagctcactgtcgtttttcgatcccgcacacgccgagacgctgttggcgcggaaatcttgggcaacgagccgtctgtttccccgactaggcaagctttttcttggccgcgcggcgggcgcgcagccagtcgtaccaggcgtccaggccttcgccggtgcgggccgagaccgggaacaggctgatgtcggcgttgagcgtccgggcatggcgggaggcgtttgccaagttgaagtccacgtagggcagcaggtcgatcttattaagcaacgtggctgccgaaatatggaacatcagcggatatttctcgggtttgtcgtcgccttcggtgacgctgagcaaggtcaccttgaaatcctcgcccacgtcgaactcggccgggcagaccaggttgccgacgttttcaatgaacaggatgtccaggccgccgaggtcgaggctggcaagggcggcgcggatctgggaggcggtcaggtggcagccgccttcggtgttgatctgcacggcctgggcgccggtggcggccacgcggcgggcgtcgttgtcggtttgcagatcgccttcaatgacagccatgcgcagttcattgcgcagatcagtcagcgtgcgttccagaatggtggtcttgcccgcgccgggcgaactcatgagattaagcaccaggatgcccttttgggcgaagaagtctttgagttcggacgcctcattggcgttggcttcaaggatattgcgcaccacaggaatctgcatggccggtctccgctattcgagttcgaggtattcgatatacagttcgcgtccggacaccaccgtatgccccagttcctggccgcagcccgggcagggggcgaaggcggcggtgggtggatcgggggtgaactcccggctgcagtcgcggcagcgcagcagcacgggggtctcttccatgaccagggccgcgccggccagccgcgagtcggcggtcatgacttcaaaggccatggacagggcttcgggcaccaccgaggacaggcggccgtggcggaccttgacggtaatgagcttttccttgccgtgcttggccatctcatcttcgatgagggccagcagactttgggcgatggagagttcgtgcatggccggtccccattacgccaaaagggcaaccgcgtaaaggaatcccgggcggttgcgcggctaatcaacgaaaaagggggccagggcggcggccaggaacatggccggcagcaggttgaagaccttgatcttcaaaatcccgagcatgttgatgccgatgccgacgataagcaggccccccacggccgagagctgggtgaggcgggccggggtgaaaaaatcctgggccgcgccggcggtgacggtcatggcggattcgtaggcggccacgggcaaaaacgacagggccacgccggcgccgtaggtggtggccaggatcatggcgatgcagccgtcgaggatggatttggtgaacagcaaggtatggtcgccgcgcagggcttcgtcaaaggagccaagcacggccatggtgccggagcagaagatgaccgaggcggtgaccaggccgtcggtgaaaagggcgttgtccgagcgcagcagggttttgatcttgtcgccggcccgggcgaactggcgttcgatgtcgatggcttcgcctacgaccgcgccgaccagcatggaaacgaccagcaggatgggcgaggtcatggccatggccatcttgacgccgatggcgaagacggaaagcccgagagcatggaacatgatggtgcggatgcggtcggggaaccggccgtgcagcgtgaggccaagcagcgcaccgacgatgatggccgcgccgttgacgaggggaccgatggggatcatggcggctccttttacccgtggccgggggaaaaggggctatcaggtcgggcggcggggcacaaggggaagggcggccgtcaaccaacgtaaacaggccccagggttgcccctgaggcctgtcaaatttggtaccgggagcgagactcgaactcgcaagaccttgcggccggtggattttgagtccactgcgtctaccaattccgccatcccggcatgaactgacatttctacgcggactcggcgtcggcgtcaagaggctgcgccggagcaaatacacggttttttgcggtctgcccgtcgctggcgctattcgccctcggggtagagggcctccatctcggcccggtaggcggcgaaacggccttcccggatggcttgcctggcccgctccatcatgatggagaaaaaggtcaggttgtggagggtgttgagccggtaggacagcaactccttggcgatgtagagatggcgcagataggcccgggaaaaggtgcggcaggcgtagcaggggcaggtggggtccaggggcgagtcgtcctcgcggtattcggcccgcttgatgttgaccttgccctgaaaggtgaaaagggtgccgtttcgggcgtttcgggtcggcaacacgcagtcgaacatgtcgatgccggcggccatgccggccagcagatcgcgtggcgcgccaacgcccatcaggtatcgcggccggtcggccgggagcaggggggcggcgtcgcccaggatgtcgtacatctcggcccggctctcgcccacggacagtccgcccagggcgtagccgtcaaaaccgacctcaatgatctgctcggcgctttgggcgcgcaggtccttgaaaaagccgccctggacgatgccgaacatgagctggccccggtcgccggcgggatgggccttccggcagcgcctagcccagcgggtggtgaggcccagggacttttcggtgtaggcccggtccgcgccgtagggcacgcactcgtcgaggaccatcatgatgtccgagccgaggtttcgctggatggagacgactttttccggcgaaaacagatgcttggagccatcgatatgggaggcgaaggtgacgccttcctcggtgatgcggcgcagtcccgacaggctgaagacttgaaatccgccggaatcggtgagaatggggccgtcccaacccatgaagcggtgtagaccgccgagcttggccaccagttcgtcgccggggcgtaggtagagatgataggtgttgcccaggatgatccgggcttttatatcctgcagatcggtggggcacaggcttttgaccgtgccctgggtgcccacgggcatgaaaacgggggtttcgatctcgccgtgggccgtggtcagccgggcggtgcgggcgctgccgtcgccggggccgagggtgaatgttcctggtgcgttcatgggccatgctatagggaaaaaccgggcctgattcaaggccaatactttaagtcttgctttaacttttagaaaggagaggccatgtccgcgaacgaaagccttgaaatgctgggccggcggctggccgtggcccggggagaggccccggccgatctggtcatcaagaacgcccggctggtcaacgtgttgtccggcgaaatccacgaagccgatgtgaccgtggccgaaggcgtgttcgtcggctttgccggcggcgaagccaggcaggtcatcgacgccgacggcgcgtacctgtgtccgggattcatcgatggccacatccacatcgaatcgaccttgctgtcgccgccggtctttgcccgggccgtggctccccacggcacctgcgccgtcatttccgacccccacgagatcgccaatgtgctggggctgcccggcatcgaatacatgctggcctgcagccaggatctgcccgtgacctgctatttcatggccccatcctgcgtgccggccacgaacatggccacttccggagcgcgtctgggagccatggacgtggccgccttactggcccgccatccggagcgcatcctggggctagccgaggtcatgaactttcccggcgtggtggccggcgacgaaaccatgctgcgaaaactcctggccgccaaggggcgcgtcatcgacggccacgccccgggcctgaccggccgggcgctcgacgcctacgccacggccggcccgcagtccgaccacgaatgcacggaatttgatgaagcccgggaaaagctgcgccgagggctgaccatcatgatccgccagggcagcactgaaaaaaacctcgatacgctgattgatctcgtcaccgccgacaactggagccagttttccctggtcagcgacgaccgcgaccccaccgacctcagccgagaagggcacatgaacgcgctcgtgcgccaggccgtggcccgaggcgtgccgccggtgcgggccgtggccatggccagcctcaacaccgcccggtacttcggcctgcgccgccggggcgcggtggctccgggctaccgggccgacgccgtgctggtggaggatttgacgtcttttgccatccgcgaggtggtgctcgacggcaagcgtctggccgactgggagttcgccgaccggtcgtgtctgaccccgccccgggccatgcgcgtgggcggtgaggtgtccgaggcccggctgtccgtgccggcggcatcaccgcggatgcgagtgatcggcgtcatcccgggccagatcgtcaccgatcccctggaaatggccccaacggtgcgcgatggcctagccgtggccgatgccgggcgcgatttggccaaactggccgtcatcgagcgccacaaagccaccggcaacctggccctgggcttcgtcaaggggctgggactcaagaacggggccatcgccggcacggtagcccatgacgcccacaatctcatcgtggccggaaccaacgacgcggacatggtgctggccgcgcgaacgctcatgatttccggcggcggctttgccgtggccagcggcggccaggtgctggcccagctgcgactgcccgtggccggactcatgagcgacgcgcccctggaggtcatcctggacgggctgtccaagctcgacgccgccttccggcaggtggcggatctcccggccgaggtcgaggcgcatccgttcatgaccatgtcctttttgtcgctggaggtgatcccgagcctcaagctcacggacaaggggctggtggatgtcacggcgtttgcgcctgtgccgttgtttattgtgtagatttggttgcggccagacttgggaaacccagtatgaagccgctgcgcgcctgaagcatcttgttccgggaatatcccgggggaagcttcgggctcgcgtgattctcgtgtttgactaggggtgcggcttgtttggttctgtgcttaatgacgtttacgttttctagtcatatcgtaatacaaaatgtccctggacacacaggagtgttcaatgggcgggcgtggcgcattcggtcgcatcaggacaggaccgtataagccggtctggcgcatgggccgggttttgacggttgcgaggcagcggcttggggttcgccattgtctcataatgtaaattatgttaacttttctaaggagaaaaagaactgccccccttttagcgacgatcttagctgggctcaattttcaagccagtgcaaccggcaatcgcttgaatccggacagccccgaccggggatcaggccacgcgttccgagcgcggtttgccaagtcgatagcctccccccacggtcggaagttttccatcagccctggcaaatttcaagatatcctcgcggctgcgttgtgcaaacacagacgccgtttccgtccgcaatggcattgagcagcttgcgtcaggccttcgcccgcccgttacaatgctgaggctgcgtcccgatcatggccagcagcccgtcatttttgttgggaatgtagccggaggatgtaccaagttcgcctctacagattaatacaccaatgtagctgctggattgtccaaatctaggcgcaggagcgtaaatgcagccgccaacggacggccgtctcccggagcaaaggtggcttgaggcgcgtccgccttgccgttccaggcatcgaatcggacggtaaggacattctcgccggcctgcccatgcaattgccaggtttcccgtagcgacggaacaagccacttgtccggggccaacccctgccgggccgccagcggacggccattaaaactgatcgatatgccttgcccggcaatggggttgaccagattgacggcagcggtcagcggggcagctttctccaggtgaaaccgcagggtcgtggtgtcgcccaaagcccagcgccattgcccttccggccctgtctcaaccggcccgactccatccatggcgagggcaaggctcgacgaatccaagatttcgcggtccatggtgttggcatacagcgacacaggcttgagccggacggctccaccggtgttgccggttatgctcggcgaccacttcccgggttcaaggtcgaatcgacaacgtaacttggaaaaaggggtctgccgccgcaaaatgaccgtgcgacgttcttgcggctcccctccccggctttcaaaggcgaccagagccggttcgtcgtcaaaggtgtaggtcaggcggacgacatttcccgcaatgggattttcaaagggtacgtgcaggcggataactagcggccccgcaaacggttttggtccgtctacaacataggtgacatatcccggcgcgtctccggtttctggtacgagccagccgccaaaaaaattgaccagattgaccccggccacggcctgacattgccgggcgaggtcccagggcgtcatgcccagggtgtcatgccagggaaatgcgggtccgatgcgtggcggcgcgtggcgcacggctgcatggtaaaccgtgccgccggcaaggggggtcttgccggtgatcgagtcgaaatgcgcaaggtattccgtgtcgcttacggccagatggcccaaaccgccaaaggctacgaagtccacggacacagtctcggcgatggtgatttggcgctgttgcagcggattgggtctgacgaaatgcgcagcgtaccagttcaccccgtcaagttcggatagttcggaataggcaaccaaggctccaggccgcaggatggtaggcagttgcttggcctgttctttgtagtttccagcgtggctgcttggggcatagtaacgattatcgctaagaagcatcatggctacgaccgttgcggccagggcggctgcctcgcccagacgccgttggccaaggaccgcgctgaggcaggttccggccagaaggcacagaaagggagcggcataactgacatgccaggcattgaaataggaattgtagcgggccagggacaacgccgccgcaggtccgaggatggttgccagggccagaaccgccaagcgtcgatctttgcgccaaacaagggccgtccccactgccgtcagggccaacaagccgcctctggcccagggggtgctgccgtccccgcagaaaatctgggttagccggtcaagggccaggagcgcggttgtggccacggaaccctgggttagcgtggacgggctggagtgaaagaaatgccaagtcgccgccactccaagactacagccgccggcatagagcgccagttgcttccagggacggggagcgggccggaatacaacgttggctgcggcaaaactcccctgcacggctaatatgagaatgctcaggtagtgtagacatatataaccgcaggtggcggcaacaaggccggtagtgagtttcattctaggcttctcgacccaacgcagcagcagctcggccccaagcagggagagaaaaatgatcaggctataggggcggacctggcgggaaaacaggagcatcgcgccattgacggtcatgagagccacggcgcaaagtgctgcggctcggcccacacgcggcgcggccagcacatagagcaacggcaacgtggccaggccggccagtaccgacggtaggcgcaggagagcgtcgcttgaaccaacaaggagcaccaatttgataagcagataaaagaccggaggatgaaaatcctcggttttggcccgtagcaggatgtcgccgaccgaggttacggcatttaatgggacgagaatttcatcccaccacatggagggaatctcaagactgtagaaacgcaccaaggtggcaatcaagacaagcagagccagcggccagccgccgcttcgcaataaggcgacaaacgacggggtgtccggtgctactgaggtggacatggtggttctccgttacagtcgccacaaggcgcgaccagccgcaggcggcggatgaaaagtgccatgggacgaacatccgtctccgcgaaggtgaccgtgccatggttccagtggctgtaggcgatcagcacggcgttggccccggcccgcccggcgatgggtatacgcaggcggcgcgtctcgccgacgcccaggctcgagagactttccagaatctggccgttggcggccaccaccaccgcctgcccgtccagggtgttgtcgaagtcgaattccaggatgagcgcctggggtttgtccagctcgaacgtcatggcgctcgtggggccaaggccccagcgaaagacgttgtccacgccgtgctcgatcttgccaaggttttgctcgcgaagccgcatggcccggggcgtggaatcgaaacggccggccggcacgatttccaggtcaaagccccggaacgcggcggtttccagattgccgccgggatatcgggccgtctggtcggcgcagacggtttccagactcaatcgcatggttttgtacggggcttctcgcacgatggagaccgtggccgcttcggccgggtccgggccaaaggaggtgaaaagcggcacgggcggctcgtcgtcgaaacgcacgacgtaggccatgcggctcccctgcccctgatttttgtactccaggatgaactggagctgcagcggcccggccgaggcggcgttgtccaagcggtattccaggcgcgagggcgtgttgttgcgggtagcgatggcctcgccgccccaataggggctgatggtcatgccggaaaaggcggcgacctggcggtagaaggccggcagctccatgcgtcggcgcaaatggtaaggaacggcctccatgcgcggggctggctcgcgctggatgggcaaccggtagatggtggcgttcaggacaggctcaatcgatgcgatggggcccacggcggcggcgaattcctcttcggtgcggccaagatggccccaggtgcgaaacggcgtgaaaaaggccagctcgaagtcgccacgttcttcggaaaggttttgcgcacggaaggggttcacggccgtgaactggtcaaggtaccaggatacggcgttgaccgtgcccgggtccgaggcagcgatgatctggcccgggcgcaggatgccggccagttgccgggccatgggcttgaaatccgtgacaaagacgttgtggtggtagctcgtgtcttcgtaatagtcgccgtaatgctgataataaaggacaccggctggaagggcggccaaggcggcggccagggggacggccaaaccctgacgcggcagcaggcgaacgacgtggccgacgagaactgccgccgggatggtcatgtagagaaaatggcgcggcgagaaataggccgttttgcgcatgaggaaaaggacacatgccgggatgaggcaaacaagcaggcagacggccagttcccggggcgtcttgcgggccatggcccagccgccggcaacgagcaacgccccaaagcccagccgtaggttcaggtcgtcatggctccacagcacatgggccaagtacgcagcaataagccggcctatctcgccaaaaccggccttgaggccaaagatggaaagcgtggtctggctcggcagaaaaaggaaaacaagcaccggcagagccacggccagggttccggcggcaaagaccgcgatctgggggaagctgacgccgcccctgcccccgggccgccacagaaggaccaggatgatcccctcggccagggcgaggtggaaggtgaaatagtggagcaagaatagtggtacgttgtaggccaggacggcatacaggtcgcggcttttgccttcgcgcacgaaacgcagcaagtggcaaaaggacagcaagaacagcaagacgaagatagcgtagggccgcacctgccgcacgtgccagacctgcatggcgctgccggccaggaacgcggtggccacaagcccgaccccgcgtccgtagaggcggcccaggccgcgccaggcggcatagaccagaatgatgccgcaaacggccgagggcaggcgcaggctggcgtcggaaagcccaactccctccacaagcttgacgcaatagtggtacagcggcggatgcatctcgcagtggcgcgagaaatcgaggatgtaagccaggggaaaccgggccgttaagggcacgatgatttcgtcccaccacatggacggggtttccaggtggtacaggcgcaggaaggcggccactgccacgaggcctgccacggccatgcgccagggccaggacgaagccgtgtcgaaggggtgaataacgtttggctgcatggggcgactgctcttggggttccaaacaggtcgccgcccggcccggactgttcccggtcagcggacggcgacaaaaaaaacgaacccgcctggggcggaaaaccggcgtatccctcagagggccggcggggccaggcgtcgtgttcttaactataatgcctgcgttcgatcctctcggacaaacgggaggacgccattgccttcaaaaaacgaaggcattaagggataccggctagcggcgggcgtcttccccggtctgctcggcggtcttgccctgctccatggcctgggtgcggctggcttcgatgcgtttgacgaacttgtcgcggcattcgtagctgcaaaaggcgtagaccttgtcgccatcccgggcgcggatatcggcatcggccggcacataggtgccgcagaccgggtccttgaccatgtcgccggtggcggccatgcgttttttggtctcggcttcctgttcctttttccgaccccggtcgcccatgaacagcttgtacaaaataaacgcggccacgagtaaaatgagccaacggtacataacgctccttgtcggcccctattatcgggccgatgcctcgattgcccctacaatattcccgccctggttggaaggcatttccgccagcgcctgggccacgcttcccccctgcccgtccgggatggccagctccggggcaaggtcggccagcgggaccaggacgaaagggcgctgccgcaggcgtggatggggaacgctcaggtcgggttcctcaaggcggacgtcgccataaagcaacaaatcgcagtccatggtccggggaccgtttggccgggccggatcgcgcacccggccaagcagggtctcgttggccaaaagcgcctgcaacagccgcctgggcgaccaggaatcgcccaaggtcagggccacgacctgattgaaaaacgtcgcctggtcggcctcgccccagggctcggtctcgtagacggggctggcgcccgccaaaaaagcgtccgggagcgcgccgaggcgctcccgggccagacgaagattggccagcctgtcgccctggttggagcccaggccgacataggcggttacagcttggcgatgcgtgacaacgcctcctccatgcgggcgacgggaacggtcatggcgatgcggaaatagccctcgcccggcgcgccgaagccgttgcccggggtgagcaccacgccggtctcctggagcaccttggtgacgaaggcggccgaggtgtggccggccggggtcttgcaccagaggtagaaggaagccttgggcgtgcggcaggcgatgcccatcttggccagagcggccacggccttgtcccggcggtccttgtagatgccccggaactgctcggcaaagggctcgccctgattgagcgccacgatgccggcttcctgcacggcctggaagatgccggagtccacgttttccttgatcttgcccaggcccttgacgagctgggcgttgcccacggccatgccgatgcgccagccggtcatgttgtaggtcttggacagggagtggaactcgatggccacgtccttggccccttcgacctccaggatcgacatgggcttttcggccgggtcatagtacatctcggtgtaggccgcgtcggagacgacgatggtgttcgtttccttggccttggccacgagcttctcgtagaaggcgcgcggggccacggccgaggtcgggttgttggggtagttgacgaagatgatcttggcccgggcccattcggcgtcggtgacgctgtcgaggtcgggcaggtagtcgttttcgtcggtgagcggcaggattttgacttcgccgccgcaaaagcccgtagccaccggatagaccgggtagttgggcgagcagacaatgaccagatcgccgggattgacgaaggccaggggaaaatgggcgatgccttccttggagccgataaggctcaccacttccgtggccgggtccagggtgacgccgaaccgggccttgtaccagtcggccacggcggcgcggaaggtcagcaggcccacgtaatcgggatactgatggttttccggcttgcgggcagcggcgcacagggcatcgatgatgcagtccggggtgggcaggtccgggtcgccgatgccaagagaaatgatgtccacgccgcgagcccggacttcggccttgacgcggtcgatttcagcgaaaagatagggaggaagggcggccacgcggtcggccatgggaaactggatcatgggggctccttatgggcgtgtgtccccgcctagggcggcaggccggccacagtaaaaacggcccccattcgtgtcaagccgccgcacaggcctcggcccgtttacgcccggcccaaatcatgccagaaaaggccctcgcgccatgagcaccaacgacacctccccggcctctccccgtccggcccatccctgggtcgaccgttacattgagcacctgattgtggccaggggcctgtcggagcattccattgccgcttattccactgacatcgtaggttttttgatttttttaaacgaccacggcgcggccctggaagccaccaccgacgagaccgtgctcctctaccttatgcacctgcgctcgcgcgggctggccagccggtccctggcccgccatctctcggccctgcgtggctttttcgcctttgccgccgacgaatcctggctgtcggcctcgccagcggcgctcatcgaaaaccccaagctgccacgtttgctcccagacgtgctgtcccgcgaggaggtcacgcgcttgctcgacgctccggacacggccacgcccctgggctaccgcgaccgcaccatgctggaactgctctacgccgccggccttcgcgtctccgaactcgtgggcctgaccctggccgattttgacgcccaggccggcttgctgcgagtcttcggcaagggctccaaggagcgtgtgacgcccatccattccctggccatggagtttctctccacgtatctctccagcattcgcggcgcctttggtcccaaggaccagcacgtgtttctcaaccgctcaggcaagggactgacccggcaggccgtgtggaagggcatcaagcgctatgccctggccgcccaggtctccacccgcatctcgccccacagcctgcgccattccttcgccactcatctgctcgacggaggggccgacctgcgcaccgtgcagatgctgcttggccatgccgacatcagcgccaccgaaatttacacccatgtccaggccggccgcttgttggccgtccaccgcgcccaccatccccggtcccgtgaccgggacaaaagttaaagtgacgctttatacatgagttctccccagaagcccgatctgctccctgctcccgtcatcgtcaccggacacgccaacgccgatttcgactgcctggccgccatcatcgccgccggcaagctctatcccggcgcaacgctgatcttcccgggcagccaggaaaaaaacctgcggcactttttcatccaaagcgccacctacatgttcaatttcagaaacttcaaggagatcgacccggccagcgtccaacaactcgtcctggtcgatacccgccagcgctcccgcgtgcctcatattgaggcggttttcgacaatccgggcctggtcatccactgctacgaccaccatcccgacaccgacgaggatgtggccgccgccttgtccgtggtgaaaaactggggttccaccaccggcatcctcatggacgccatcatggaaaaggacctgcccctgaccccggacgaggccaccatcctgggcctgggcatctacgaggacactggctccttcacctttgcctccaccaccgaacacgacctggccgccgccgcttggctgcgcgcgcgcggcatggacgtgggcgtcatcgccgacctcatgacccgggagctgtcctcggaacagatcaccatcatgagccagctcatcgagacggcgcaaacccacgacatcaacggcatcgaggtggtcatcgccgaggccacctccgaccagtacatcggcgacttcgccctgctcgtccacaaattcctggacatggaaaacctgcgggtgctttttgccatcggccttatgaacgaccgggtgcacctggtcgcccgttcgcgcaccccggacgtggacgtgggcaagatctgctcggccctgggcggcggcggccacccctacgccgcctcggcctccatcaagaacatgacgctgacccaggtgcgcgaggagctgttcggcctgctctacgcccagatcaatccgcagatccacgcccgccagctcatgagcaagccggccgtgtccatcgaggataacgccaccatgcgccgggccgaagagatcatgacccgctacggcctcaaagccttgcccgtggtggccaagggcggccggcgctgcgtaggggtcatcgagcacgacatcatggacaaggccatcaaccacggcctgggcgacgtttccgtcagcgagtacatgatgcgcgatccggccgtcatcaccccggacaccgacctatacgccgtcatggaagtgattctcggccgccgtcagcgcctggccccggtggccgaggacggcaagctcgtcggcgtcgtcacccgcaccgacctggtcaacaccctggtcaaggagccgtcccgcatcccggaatcgcttttgcccgagcgcaaaaaagaccgcaacgtggctgggctgctgcgcgagcgcctgcccaaaaagctccaggccctgctcaagcaggccggcgaactcggccagcagaccggccacgccgtctacgtggtcggcggctttgtccgcgatctgctcctcaagcaccccaactttgacgtggatctggtggtcgagggcgacggtgtggcctatgccgccgaactggcccgcatctacggcggccgttacaaatcccaccccaagttcaagaccgccgtggtcatcctgcccgacggccagcgggtggacgtggccaccgcccgcctggaatactacgaatacccggccgccctgcccacggtggaactgtcgtccatcaaaatggacctctaccgccgggatttcacggtcaacgccctggccctgcacctctcgcccgaacgcttcggcgatctggtcgacttcttcggggcccagcgcgacatcaaggaccgggtgctgcgggtgctccattccctaagcttcgtcgaagaccccacccgcatcgtgcgcgccatccgtttcagcgagcgcttcggcttccgcatcggcggccagaccgaccggctgatcaaaaacgccgtgcgccacagctttttccacaagctctctggttcccgggtcatgcacgagctgcggctcatcttcgaggagaaaacgccgctctcctgcctgcgccggatgcaggactacaagctcctggccgccatccatccgctcctggcgctgaccccctccaaggaagccgtgcttctggaagtggaaaacgtcatcaactggtaccgcctgctctacatcgagccccagcctcaggtctggatgctctacttcctgggcctttgcaccggccttgacccggaacaattcgccatcatcgcccgccggctcaatttctccaaacgccaggcggccgagatggtcgccctgcgccagcagatccgcgacaccgcccagggcatcttcaactgggaataccacaaggggccaccctcggagctctatttcctcctcgaacccatgccccttgaaggcgcgctctacctcatggcccgcaacccccgcgagccgctccagaagtacgtgtccctgcacctgaccacactgcgccacaaacgggtggaggtcacgggcaacgacctcaaggccctgggcgtcgaggccgggccgcgctacgccgacatcctgcgtcgggtggtcggcgcggccatcgacggcttggccgtgtgccgggccgaacaactggaactggcccgccgcctggccaagggcgaaccagtggccgacttcctcgcccgccaacccggcggcgaccgttgccagttgcccatggagagtggggagatggaagagaagaggcctccggcggccgggggggatgatcccccccggaccccctcaacggggggatgcgtttaggccccctaacccatttctctatgtggggggtccgggggcctcaggcccccggccgccggaggcctcttctccgtctccccggcgtctcgacatttggcgcgcttgggcctagaattagggccttcacgcgtcaccttcaagcttgcccaaggatattcccatgccctgtccccgctttaccgtcaccggtccggccgatttcggggcgcttcgcgccctgctcgccactcgcgaggaggcggccggcgacgccgaggaaaaagtccgccgcatcctggccgacgtggccgagcgcggcgacgccgccctggtggaactgacccgcgatttcgactgcaagaccttcgacgcctcctgcctgcgcgtgccggccgccgacatcgaggccggcaagaacgccgtccccgccgccgacttggccatcattgaggaagccgcggccaacatccgggacttccatgagcgccagaaggaacagtcctggtgggttccgtccccgggcggcaccatgctcggccagatcgtcaccccggtggacgccgccggttgctatgtgcccggcgggcgcggcggcgaaacgccccttatttcgagcctgctcatgaacgccatcccggccgccgtggccggcgtaccccgtatcgtggccgtgtccccgccccgggccgacggtacgctcaatccctacatcctggccgccgccgccgtgtgcggcgtcaccgagatctaccgtctgggcagcgcctgggccgtagccgccctggcttacggcaccgatgccattaccccggtggacgtggtggtcgggccgggcaacatctacgtcaccacggccaagcgcctgctcatcggccgcatcggcatcgacatgatcgccgggccaagtgaaatcgccattctggccgattccacggccaaccccgaatggctggccgccgacatgctgtcccaggccgagcacgatcccatggccgccgccgtgtgcataagcgacgacaaggccctgcttgacgccacttgcgccgagttggccaaacaagtggctgccctgcccagaaacgacatcgccgccgcctccctgtcccactacggagcgctagtcgccgtgcccgatatcgacgtcggcatggaactcataaacaccatcgcgcccgagcatttcgagctgtgcgtggccgatccctgggtcctggtcggcaaggtgcgccatgccggcgcggtatttatgggccaccactgccccgagccggtcggcgactatttcgccggccccaaccacgtgctgccgaccatgggcacggcccggttctcctcggccctgtccgtgtccaccttcaccaagaaaaccagcctcattgccgccgccccgggctacgtggccgccaacggccccaagatcgcccggctggccagactcgaaaatctcgaagcccacgcccgcagcgtggaatgccgtttgaaataaggaaggagcgccatatatgcacgccgtgaccgaaaccgacatcaaggcctatcccctgcgctcgcggggcaaggtgcgcgacatttacgatctctcgccggacagcctgcttttggtcaccaccgaccgcatctcggcctacgacgtcatcatgcccgaccccattccgctcaagggcgtgatcctcaaccagatcacgctgttctggatggacatgttcaaggacatggtccccaaccacctgatcgcctcggacgtagctgatttccccgcgccgctggcccctcacgccgccgatctggccggccggtcggtggtggccaaaaaggccaagcctctgcccatcgagtgcatcgtgcgcggcttcatcaccggctcgggcctcaaggactatcaggccacgggttcggtctgcggccatgccctgccggccgggctggtggaatcccagattttgcctgtgcccatcttcaccccgtccaccaaggccgatctcggcgcccatgacgaaaacatcaccctggacacggccaaggagatgctgggcagcgcgcttttcgccaaggtcgaggccacgagcctggccatgtacgccaaggcccgggactacgcccgggagcgcggcatcatcatcgccgacaccaaattcgaattcgggcttatcgatggcgagctgatcctcatcgatgaagtgctgacgcccgattcctcgcgtttctggccggccgagggctacgcggccggaaaatcccagccgagctacgacaagcagtacctgcgcgactggctcgtctccataggcttcaacaagcagccgccggccccgaatctgccccaggacgtcatcgccaagacccaggaaaagtacctggcggcctacgagctgctgaccggaaaaaaattggcctagccggcattttttgcttgccaaggccacgggttctttgtaattaccaccgtctcgcggagaggtgtccgagcggccgaaggagtacgattggaaatcgtatgtaccttaacgggtaccgagggttcaaatccctccctctccgccacagttttcagggaagtcggatggcggttgcgccgccaaccccgtcaggtccgaaaggaagcagcggtaacggttgcagccgggtgtccggcttcccttaaaagcgcgaggcaactcgcgcttttttttatttttcctgatgttctggcccaccctacgtcgaattcaggcctgccatgaaaaaatccctccagaatgtcttgttggtttgtgcttcgatgcttctgacgtttgtgtgcgtggaagctggtgcacgattttggctcgcgcacaaatatcttctcggcaatttcaagacgacgtccacatttgcccaaagcgatgccgaacagtccggaaataccgatcctctgggctgggagacgcccaacaggacacacttctactacgtctacgacgaaaaatccgacatcgtttggaagtccatataccatttcaacaacatggggcttgtttccaggcgaaactatgatccggtcaaaaaaactggcgagtatcgaatcgccatcattggcgattcgtttacggcatccgtgcaaatgatggagccttggcccgaccggctggaggacgttctcaacgcggacaaatccctcaaggacaagctcggcgtcaccacgttcaaagtctacaaccttggcatgtatgcggccggtttccccgatttcgtgaatttggccaggatagcccagaagctcaatcctgatatggtgatcgtcaacttcattgccgctgattttcctcgatgcaacaattgcacgacggaaatcgacaatccgctcaaggataaagccaagcagttggtcagcggcgaaatccccgtgccgattgatgccgagggcaaggaagtcggctacctgcgcgtgtcctgcgaacagccgccagtggatttctccaacgacacctgccgccattcctataatttgtccctgccgccggagatggccgccgatccggccaaggtccgcaaagtgaagcaggaagtggtccgccggtttctgcgcggccaactgctgacgtccctctatccctattccatcgccatggccctggggaaatcgccgtccctgaccgatttgcgccatccggagtggttcaagggaccggaaacgaaaaaacgcgagctttcccaggaggaaatcattctccaggcggcgggcagcatggaggccatccgcgacatgtttcccggcaaggtgtttttggggatgctcaatccgacctatgacgatctgacgtggcagccggccgaagacacgaccagagcgctgcttgccgctgcgccttggctctcggtcaaattgatgcgggaatatctgcccaaggacaaatccaaggaagagatgtacgcatggttctgcctgccccatgacgggcatatgagcgacaagggcggcgaggtctacgctttagccactgcccgggtcatcgaggaagtcctcggcaagccctaaccgcgtctcctctcacgccccagaaaacaaacgtcgggatttgctggaatcagcaattgttttgatcccgatcggcgaaatgcgcctgcggctttcagggacgcggtcctagtccgccaaaaaggccagttccttctcggcaaagcccacggcctccccgcgcagatacccggcctcgatgccgtggcccaaaagctcgccaagggtcaggggcgcggccacgggcatgggaaattttcctcgcaggctttgcgggcgcttgtccacgaaaacgaacaacgacggctggccaaggccctgctcgataaaagcccgggccgcctctacggccgtgccgcccgaggtcagcacgtcgtccacaaggaccacgggcgcgcccttctcgccgccaaacacctggccggccaaccccttttccgaggcatcggcccgaaaaagggccaacggcaggtcgaagcggccggcaaaggccccgcacagcaccggcgagagcaggctcgacacgctgcccaggggcaacgcccggccttccagccattccccgaacacgtcgctaagaagggccagattggccgcttcgcagacgaaatggcgcagggacacgtagacatggctctggcggccggatttgagggtgatgggggcgtcgcgcaccaccaccgcgccggcttcccagaaacgctccataagggcctgggtcagggtgatcacttggccgcctcccggtgggcgtcgtacatggccaggtgttcgcgcagcatctccgggatgggcaggttgtaggggcagcgcgtggcgcattcgccgcagtccacgcagtcgcgcaccgtctccatgaccgcgccggagaaattgaccgccttggccggcgacagacgcctggtcaccacccggtacatcatggcgtaggtgatgcgcacgccctggggacagggctgacagtattcgcagcgccggcaaaagcgcgacccgagttcgtcccggtaggcctgcgccttggccgcgtccgcctcggtccagaccggctcgcccgaaaacacggacacggcctgctccacctgctcggcctgatcgcagccgcacaggacgagcacatctttttcccggcgcaggaagcgcaaggccacctcgccgtcgtcgatcatgccgccggcaaagggcttcatgaccaggatgcccatgcccttggcccgggcttcggggaaaaggttctcggcggcctcggtctcgacgatgttgtagggaaactggatggtggcgaaaaggccggtggccacgagtttgcgggccatgtccaggctgtgggaggtgatgccgatgtggcggatcttgccctgctcccgggctttgaccaaggctcccatggccccgtccgggccgaaaagcgtctcgtagtcctcgggcgtggacacctgatggggttggtagaggtcgatatagtcggtgcggaggcgcgtgaggctcagctccagctcctccatggcctccttggctcggcgcattcccgtcttggtggcgatgaccaccttgtcccggaggccctcgaaggccagtcccatcttctcttcgctgtccatgtagcggttggcggtgtcgaaaaaggtgatgccgcgctccaaggccaggcgcatgaggctggccgcctcgtcgcggccaaggcggatgatggggatgccgccgaacccgatggccgctgtttcgatgccggtctgtccgaggcgaatggtctgcatggcttggctcctttggccgcccggacggcggcgagctggcggtttggtccgagttgtgacgccggccccggcggctgtcaatgcgtgggcctggctggaccgtcctggctggctttatgggtcacggcttcgaaatacaaactggccgccacccccgccagacacagcccgccggccagggcgatggcccggggcgcgccgagcaggctggccgccccgccggccatgagcgacccgaagggagccatgccgaccagggtgacggcatacagcgccatgacccggccacgcatggcgtccggggtgcgcaactggaggatggtgttggaggcggcgaaaaagagaatcaggcaaaaccccagggcggacgcgatggcagctgaaagggcaaaggtccgggaagcggcaaaggccatcatgcaaagccccaccccaagcccgcagaccgcccgccagcgcgacaggccccggctttcgcgccgcagggccaaggtcacggccgcgaccacgctgcccgcgcccatggaggcggtcatgaagcccagctcccgcgccccctggccaaggacggcgttgaccatcaccggcagcagcaccatgaccaccgagacgaaaaggctcaccgcaaccagggcgctcaggatggcgcgaatcttcatgtccccgtaagcgtaggccagtccctggcggatggctccgccggccggcggacaggccggcgcgggcggggccggcggcaagcgcatggcggccagggcggcgatgacggccaagtagctgacgccatttacaaagaagcaccagccttcgccgatggcggccacgagcaggccggccagggccggacccagcacccgggcgctgttgaacatggaggaattaagcgcaatggcgttgtgcaggtcgtcgcggcccaccatgtccaccacgaaggcctggcgggtgggcatctccacggcattgaccaggccaaggaaggcggccagcccgacgacctgccacagggcggccgtgccggaaagggtcagccaggccagcgtcagggcctggaccatggcggcggcctgggccaggatgaggatgcggcgcttgttgccccggtcggccaggcaaccgccccaaagaccgaagacaaagaccggaatatggctggcaaagccggtcagtcccaaggccaggctggagccggtcaggcggtagaccagccaggacacggccacggactgcatccaggtgccggtcagggaaatgaactgcccggcgaaaaaaagccgaaaattgcggtggcgaaacgagcgcaacagcaattcccgggctttggcgtttggagtcggcatgaaaaagagcataacggcaggccgagcgaactcgacctagccgggtgctaggcgtttgttgcgccgttttcctggggctgggtaaacagcgtgtgcaaaagacgcatgctggcggtgacgagttccacgtcatccggtcccagacgggcgagcttggcggcaaaggaggccttcaccgcttcccgggccttggccagaatggcatggcctggctcggtcaggcccagacgcacccggcggcggtcctgggcgtccggggtgcgctcgataaagccccggtaggtcagggtatcgacgagcttggacatcgagggcagggagacgccgatgtattcggccaaatcggtgaggttggaaccgggattgtgccgcaaaaaggccagactgcgcaactccggcacgcggaggtccggggcgctctggctgcgcatggtgcgccgcaggtcctgcatgatcagcggcatgacatcgagcagctcgcgggcgcaggtgtcgagtggatcggtcatggcggtatccttgggattaatagttagctttagaaatagtaagtcgcggacaggaccgcgtcaaggccgctttacgaggatgacaacaagtcgtcgtccatgtgggccgccggaggcaatcccaggcttcggcagaccgtggcggccagacgggtttgggacacgccgtcggctgcggccaggggcaggttggaaaaaagcgaacccggcacaaaggaagcatccacgcagtggtcgccggaccatttttggcggttgtcggcgaagacctcgccgcccgtgccgccgatgaccgaggtccaggccagacggtatggcggccgacaaccgacgatgaggtccggagcttctccggccagggggccgctgtagagggcttcccggcggtggacggcggcgatgggcgaggccggaccgtcggccagggcggtcaggcgggcggccagttccccggccagggcgtcggcctcgcccagcggcacgatgccttgctgttcgcggccggccacattgaggcacaccgatccgaaacccagagcaaaggcccgggtggccgaccagtccacatggcggaacagttccccgctgtcggtcgaatcgtggggcttaagcttcatgtagccttggcgcacgagccaggcattgaggctgatggagcgggtgtaggaacaaaaaccgtgatccgagcagacgaaaagcgccgtgtcatccccggccgcgtctatgaccttgcccaccacggcgtccatgcgggccagatggtcgtcgatgaccggccccaggcgggccgcctcggccgcgtcatacagcggatgcgtctggtcggccaaccgccaaaagcagtgctggatacggtcggaagtgtcgaagaccacggagagcaaaccctcgcggaaccggcccagttcgaagtcgagcatggcctcgcgctcgcgggtcacgtcgtcgcacagggccagaaacgcctcgtcggtcatgacgccgtcggtcagtcccttggtctcctcgggcatccccagggtggaataggggccgccaagggcgtcggtcagctcggcggcgtatccggctggcgcggcaatgggcaggcagggcgcggccgggtcgatctggatgggaccgaggtagagttccaaaggctccaagcggcccagccacagccgggtaacgccggccacgggactgccctgcccggtttcaaagcgcacggaaagatacggcgaccactgccccggcccgaggctgccggattggccgccaagggtgtagtccagtcgtccgtcctggcgggccagggccaaggggaccacggccggagtcttgcggccggcgaccacggccatggggccttccacggccagggtggccttgccgtccacgaaccgcacgggcacgaaccggccccggccgccttggccatctgcttcttcggcgtattggacgtagttgccaagccgccccttgacgtcgggcgcgccgagtccggacaggaccgtggccccgccgaatgccggcggatagctcaccggccagcgcacagcggtggtgggcagcccggccttggccgcgacctcgaaaaacgtctcgcagtcgtaggctggcagcggcgcgccgcccgggccgggacgggtcagcgacaggcgcggcagataggtccccggggcacgcacgatgaagtcgaaaatgccgtggcggccgggattggttccggtggccaggctcgtccaggccaccggactctgggccggattggacgtggccagggaaacgaaacgccccccagacgccagccgggcgagatggggcagccggccggcggccagaagccgacgacacaggccgggatcaaggccgtcgatgccaaggacgagggctttacgaaagggctttggcgacatggagttcctgtttggcgacaatctggctgtcgaaaacggttctccgcatagcaaaaaatgtgtcgcctgcccagccccgaaaaacccctcaaagacccaaggtcaggccaaaccggccagataggccaaggcccgcatggccgccgcccgtccttcggccacggattcgtccagcggtttggggccaaggcacaggccggcggcgaaaaggcctggccggggcaggtccacgggcgcgaagacgggatgggccggggcgaaaaagcccaggtggccgcgcggcaggtcaaaaagcccggccagctcgtccaggcccgatgggaccaggggcgcggccaggatgaccacatcgggccgcaaccgaacatcgcggccgagcagccggtcgataccggccacgacgaggtccggccccaaccgttccacctgggccggcgaggcagcgtcgtggcggaaaaaggccacgcccaggcgtcgggcctcggtatacagggattcaaaccgaccgtaggtggtgatgtcgcggtgaaacacggccacctgggcgtcgggccgggcttttttgagttccacggccgcttgtaaggcctgggcgcagcaagtccgggcgcaggcgtcgtagccgccctgcccttggcgcgaacccacgcactggatgaaggcggcgagcctgggcgcttcgtccgggccggggtgcaaccgccgccagttctcgaattcgagctgggtcatgacgcgcgggtcgcggccgtagagatgcccgtccacccgggcttcggccccgcccagggccagcacggccgcgccaaaggcgatgttccggcggccagccgacgtttccacttcgccgttccactcgccggcttggccggacaccccgaccagccgcgcgccgcacagcacctcaatgttgggatggccaaaggctgcctcggccatggcggccacggcttgccgggtgtcgctgcccttccagaccgtcgggtgctttcggggattgccgccaagggcgtcggctttttcaatgagcacgaccggaatgccactctcggccagccccagggaacaagccagcccggccgccccgccgccgactaccagcacggccggcgtgtcgcgccgtggggtcggcacgggagcccaggcccaggcctccagggcggcggccgagccttgcactgtggccatggccacatcggccgggccggacgcgccgccggccacgaacagccccggccggttggtcacggccggggcaaaggggtttgtcggcacaaacccctgcttgtccgtttccaggccgcaggccgccgccagttcccggccctggggcgaggggccaaggcccacggccaacacggccagatctacctggtcaaggacttcgcccccctgctcgtcaatgacccgaaaaaccacgccccgaccttccgggccgggttccagggtatggggccgggcatagcgcacggccacgcccgaggcttcggcggcattggccagggcttggcctcccgtaccatggacgcgcaggtccatggcgtagatggtccgccgggcttcaggcaaggccagggcctggcgcagggaaacgacgcagcacaggctggagcaggccgggcgttcctccgggcggcgcatccgcgaacccacgcactggataaaggccagcgaagccggcggcgcgtcgtcggacggcctgcgcacgctcccagccaccagcatggtttcgagttcgatgctggtgatgacgtcggcgaccgggccatagccgaaaaaatcgagttcaccggggtggtagggaaccagacccgtggccaggatcagggaggcggcccgcagttccagtgcctccgtttcgccggcttgccggaccgtgagcacaaggtcgccggggctgccggttacgcccagcaggcggcagccgcccagccggctgatgcgcggctgggcggccacggcctgggccatggcgtccagggccagcccggccggttgcccggtctggaccagggtggccagatgcctggccgcgccgccaagcatcggcccggcctcgataagcaggacctcgcgtccggtcgtggccagatccagggcggcgcgcaggccggccgggccggcgccggccacggccacaggcaggatggcttggggctccatgtcaaaagcctccgtcgagttcggcttcgaaatgctggcgctgcacccggaagcgttcgctggccgcctcgacttccgctgccgtccagggggtttcaatcatggtctcggccacgagctgccagaggtatttgacctcgtagcggcagcggccgggatagaaccggggcaggcgcttttgcagctgatcgcggcagttggcgcagccgaccaccaccacgtcggcccggcaggcttccaactgctccaccttgaaccggccgtgggcggcggattccttttcaaagggcatgggccaattgccgccgccggccccgcagcaatagttgttggcccggtccggggacatggcgacaacgttttcggcacccacgcaggcggccaggatggcccggggttcgtcgtagtagcccttgccgaaatggcgttccaattcgcggccgtgtttacaggcgtcatgccagacatagctccggccggcgttacgggaggggtcgagaacgaggcggcccgaggtgatgcgatccaggaggtagtcgtagaaatagacggcgtccacttgcctggaagggtcttccagggcgcaggtggtcagacccaggcggcagccgtaggaaccgccgccgcagtccgggataaacagacgcgccgcgccgaggttgcgcatgaggtcaagcttgcgccgggccaggaccagggagacgtcggcgttgccggtgaaaagcccccagtcctcggcctcccagttgcgcgagggcacggtccagtcctcgcgggcgttgtagaagatgcgccaccaccacttgaggtcgtcgaagtcgccaaagacttccttggaattgaggaagacgagcagttcggcgttcttcttgtccacaggcacataaaagcccgggcattcttcctcggccagctcgccgccgatgtcggccagggtgtcgaggtagtcttccagggggatggccagggtgttgccggtctccagcaccgaggccacgcccttttccaaggttccgggcacggaagaacgcggggccagatcacgaagcagggcaaaaacggccggcaggtcgatgcccatggggcagacatgggagcagcggccgcaggtggtgcagacccagggaaaggccgaggcgatgacttcggcctcccggcccatagccaccagccgtatggccgtgcgcggatcgaaaccttccatgcctggcgtgccggggatgggacaaccgctggcgcaggccccgcagcccaggcaggatcggacgtccagggcgcgcagccggtcctcgggttccggcagggcggcggcgagatcgagcagttccatggcggtctcctggcgcgggcatccaagggaaatgcgccgcggacgcaaggcggcattgccggaaaaaacaacggtttcgtgaagaaagcgttgtccgaacagcgaacagggagcttgcaccagccttgtatgccagaggtaacatgcaggaaaataaattaaaattggcttttttcctgcccgcccgcccagactgccaagagctttgaatttacggaacaaaatgggggaaataaaaagtggttcccgtccagcggcaacgcccgccttctgcacctcctgaccgacaaagaacccaaccttcgtcccaacccctttaaaactttctccatacggggggtctgggggcctcaggcccccagccgccggaggcatcttcataaaaaaaagcgcgccggtcgcccggcgcgcttgcaatattcgctatctccaacaatctacaacatggcctgcaacatggccatgggcgtggccgaggggagcttgatgcgccggtcggccagggccttgtcggcgatacgcgtgagccactcccgggaggtggtcaggctttggaaggtcagccagccgcgcccggtctcgtcggtggccaggccgtagccggccagctccacccggatgggttcgctctcgcccaggggcaagacgtccacgcgcacggagcgctcggcgcttttgatctccagggccagcacctcgccgtagggggcgagaaaaggcttggcagccgagagcaagagcttggacagagacttgtccttggccgaggccagatcgatattgaggttcatggaggactaccaggaaagagccagggacacgtcgtccaggcaggttttgagtccctcgccgcagggcgggatgatgtagttgccgtcgaaacaggccatgcagtacggcggttcctggctgttgccgcgcaccgactccaaaaggccctcgatggagaggtagtgcagggagtccaggccaatgaaacgggcgatgtcgtccacggactggtgggcggcgatgagttcgcccttggaggagaagtcgatgccgtagaagcacgggtagcgaatgggcggacaggacacgcgcatgtggatctcgcgggcgccgagttcgcgcaggcgtttgacccgggtgcggatggtggtgccgcgcacgatggaatcctcgacgatgaggatgcgcttgcccttgatcatgctcttgaccggattgagcttcacccggacgctgaagtcgcgcatgtcctgggagggctggatgaaggtgcggcccacgtagtggttgcgcaccatgctcatctcaaagggcaggcctgaggcctgggaatagccgatggcggcgtagaaaccggagtcggggaacggcatgacgtaatcggcgtccaccggcgcttcatgggccagggtgcagcccatctgcttgcggcgttcgtagaccacctcgccgaagacctcggagtcgggccgggcgaagtagatgagttcgaacacgcactggcgcaccggctggggatcgcagatgcgatacgactggagccggcggtcctggatgacgagcatctcgcccggggccaccgagcggatggcctcggcctccatgaggtcgaaggcgcaggtctcggaggccaacacgtaggcgtcgcccatgcggccgagcatgagcggccggatgccgtggggatcgcgcacggcgatgatcttgtcgttgcacaaaaggagcaaggaataggaacccttgaccttgttgcaggccttgatgacggcttcttccagggaacagccgtttaagtacttggcaatgaggtggacaatgacctcggagtcgatggtggtctggaagatggaatcgctggcttccagttcctcgcgcagctccatggtgttgaccaggttgccgttgtgggcgatggcgaggttgtagttgccaaagcgcaccagaaagggctggcagttgcgcaaaagcgacgcgcccgtggtggaatagcggatatgccccaccgccaccgagcccttgagttccttgcccaggtggcgttcgctgaacacgtcggcgaccaggcccatgccgcgttgttcgcggatgcgcgtgccgtcccaggtgacgatgccggcggactcctgcccgcgatgttgcagggcgtagaggccgaagtaggtcatccgcgcggcctcggggtggccgtagatgccgaacagtccgcaatattcctttttcatgacgcgccacccggggcctagttggccccgtagtactcctgcaagcttttcacggtgagtccggctccgcgcagttcgcggatggcctgggccatggcccgggctccggcggcggtggtggtgtacgggatgccgtacaaaagcgccgtctgccggatggacatggaatcgcgcacggtgcgcttgtcggacacgaggttgaccaccagatcgacctcgcggtttttcatgtggtcaacaatattgggccggccttcgaagaccttgagcaccggggtcacggcaatgcccttcccttggagataggcggccgtgcccttggtggccaggatcttgaaacccagctcgccgaggatctgggccgcaggcagcacctcgtccttggcgttgtcggcgatggacagaaacacggtcccctgctggggcagcacctggccggccccgagctggcttttcatgaaggccagtcccacgcactcgtccacacccatgacttcgccggtggagcgcatttccggtccgagcaggacgtccacgcccgggaagcggttgaacgggaagaccgattccttgaccgcgtagtagccggacttgcgctcggcccagggattgagatccttcagcttctggcccatgatgaccttggtggccagcttggccaggggcactcccgtggccttggacacaaagggcgaggtgcgcgaggcccggggattgacttcgaggatgtagatgtcgccgtctttcaccgcgaactggatgttcatgaggcccacgacaccgagttcctcggccagggccacggtctggcgttcgatttccttgatcagcgccggatcaaggctgtggggcggcagcacgcaggccgagtcgccggaatggatgccggcttcctcgatgtgctccatgacgccggccacgtaggtgtcggtgccgtcggacacggcgtccacgtccacctcggtggcgttgaccaggaacttgtcgatgaggatcgggtgcttacccgaggcgaccacggcgaccttgaagtagttctcgaggtccgcccggtcgtagacgatctccatggcccggccgcccagcacgtaggacgggcgcaccaccacgggatagccgatcttgtcggcgatggtcgcggcgtcttccacggtaaacgccgtgccgttggccggctgacgcaggccaagcttttggagcagcgtctggaagcgttcgcggttctcggcccggtcgatgctgtcgggcgaggtgcccaggatgcgcacgccggcgtttaaaagcggcacggccagattgagcggcgtctggccgccgaactggacgatgacgccctcgggcttttcgacttccaggatgttgagcacgtcctcgaaggtcagcggctcgaaatacagccggtcggaggtgtcgtagtcggtggagacggtttcggggttggagttgaccatgatcgactccacgcccatctcgcgcagcgcatacgaggcgtggcagcagcaatagtcgaactcgatgccctggccgatgcggttggggccgccgccgaggatgacgaccttgcgggcggccttgggggccacttccttgccggtttcgtatgtcgaatagtaatacggcgtgtaagcctcaaactcggcggcgcaggtgtcgacaaggtagtacgtgggggtgatgctcatgtccttgcgcagcttgcgggcatcgaggctcgacggcaggcccaggatcgtggcgagttggggatcggagaagccgtttttcttggcgtcggcgataagctcgcggcagtcggcgttggccggggaaatcttgtccttggggaaggcggcgatgcgcgcttccatgtcgacaatttccttgaactggcgcaagtaccaggggtcgatccaggtggcctcgaaaatgtcttccagggagacgccgcagcgcatagcttcgcgcacctggaacatccgccgggaattgggccggcgaagggcggccagcaaggtgtcccggtcggcctcgcagacgtcgtttatggccgaaaagccggtggccccgatctccagggagcgcaggcccttttgcatggcttccttgaagttgcggccgatgctcatggcttcgcccacgctcttcatggccgtggtcaggtagtcttccgagcccgggaacttctcaaaggtgaagcgcgggatcttgaccacgcaatagtcgatggtaggctcgaaggacgccatggtctcgcgggtgatgtcgttggggatctcgtcgagggtgtaccccacggccagcttggccgcgatcttggcgatgggaaagccggtcgccttggaagccagggccgaggagcgcgacacacgggggttcatctcgatgatgaccatttcgccatcggccggattgaccgcgaattggacgttggacccgccggtttccacgccgatctcgcgcatgatggcgatggcggcgttgcgcatctgctggtattcgtcgtcggtgagggtctgggccggggccacggtgatggaatcgccggtgtgcacgcccatggggtcgatattttcaatggaacagatgatgacgcagttgtccgccttgtcgcgcatcacctcaagctcgaattccttccagccgataatcgagcgctccagcatgatttcgcttttcatgctggcggccaggccgaccgaggcaatcttctccaggtcttcctggttgtaggccacgccgccgccggtgccgcccagggtataggccggacgcacgatgatggggaagggaatgcgcttgccccactccttgacgtcctccatagtgtggcagatgccgctttgcggaatcttcagcccgatgttgtccatggcgatgcggaacagttcccgcgattcggcctttttgatgacgtccagggacgcgccgagcaggtccacgccgtattcgtccaacacgccggactcggccagggccacggccgtgttgaggccggtctggccgcccagggtcggcagcagcgcgtcggggcgttcccgggcgatgatgcgggcgacggtgccgggttcgatgggctcgatgtaggtgcggtcggccaatcccgggtccgtcatgatggtggcggggttggaattgacgagcaccacttcatagccctcttctttaagggctttggcggcctgggaacccgaatagtcgaactcgcaggcctgtccgatgacaatgggcccggagccgatgatcatgattttttttatgtccgtccgtttgggcatggcgtggggtggttttttagagggtgaaacgacaaatgcggaaccggcaagggataagccagttcgcttgatcgcgcaaggcctttgcgcccatggcccgccgccggctgacgcccgggtctggcgcgccttggcaaggagccgggggtgacggaattgttgcatgttggcggccgcccgccgggaccggccgcccttccttgacttccgctctgccttgattaaaaaagcctgtttctccggcgtcgcgccgaagctggaatcaagcgcaaggacccgtcatgaccaccgattataaaaagactctgcggcttccccagacctcctttcccatgaaggccaacctcagggagaaggagccggaaaccctgaaatattgggccgacaacagcatttaccaagccatgctcgcggcccgggaaaacgccccccgctacatactccacgacggcccgccctatgccaacggccacctgcacatgggccacgccctcaacaagattttaaaggacatcatcgtcaagtcgcgccatctggccggctttcaagccccctacgtgcccggctgggactgccacggcctgcccatcgagcacaaggtgtcccaggaactcaaggccaagggcaaggaaaacctgcccgccgtcaccgtgcgccgcctgtgccgggattacgccacgaaattcgtggacatccagcgcaaggaattcaagcgcctgggcgttttcggcgactgggacgatccttatctgaccatgcgtccctcttatgaggcggcaacggccttggccttgtgcgattttgtggagaacggctcggtttatcgtggcaagaagcccatccattggtgcctgtcctgccagaccgccctggccgaagccgaggtggaatacgccgacgaggtttcgccctcggtctatgtccgtttccccctgaccgatcccaagatcaaggacgtcttccccatggccgatccggggaaggcctacgccgtcatctggaccaccacgccctggaccctgccggacaacatggccgtggcgctgcatcccgaattcacctacgccctagtggccgcaggcgaaggccagtacgtcctggccctggagcttctcgacgccgtgcgcgaattgttcggctggaccgaggccaccgtcctggccgaagccccgggcgcggccctggaaggtttggccgcccgccatcccttctacgaccggccgtcccccatcgtcaccgccgactacgtcaccctggacgccggcacgggcctggtccacaccgccccgggccacggccgcgaggactacgacacgggcctgcgcaacggcctggacatcctctcgcccctggacgacgccggccggttcctggacgtggtcccctacttcgccggactgaccgtctgggaggccaatcccaaggtcatcgagaagctgaccgaggtcggccatctgctggcttccaagaagctcaagcactcctacccccactgctggcgctgcaaggagccggtcatcttccgggctaccacccagtggtttattgccatggaagccggcgaactgcgtcaaaaggccctgtccgccatcgaaaacgacgtggagtggattccggcctggggcaaggaacgcatccacaacatgatcgcttttcgccccgactggtgcatctcgcgccagcgcaactggggcgtgcccatcctggcccttatctgcgaatcctgcgacgctgcctacaacgacgccgactggatgcgctcggtggccacgaaattcgccgaccacgagcggggctgcgactactggttcgaggcggcccttgacgtcatcgtgccggccgggctgacctgcccccaatgcggcgggacccactggcgcaaggagaccgacatcctcgatgtctggttcgactcgggcacgagctttgccgctgtcctcgaaaagcgcccggaactcggcttcccggccaacatgtatctcgaaggctcggaccagcatcgcggttggttccacagctcgcttctggcctccatgggcacgcgcggcgtcgcgccctacaagcaggtgctcacccacggctacgtcgttgacggcgaaggccgcaagatgtccaagtccctgggcaacggcatggaaccccaggagatcatcgacaagcacggggccgagatcctgcgcctgtggacgtcggccgtggactaccgcgacgacatccgcatctccgaggagatcctggcccggctggtcgaggcctaccgccgcatccgcaacacctgccggttcatcctcggcaatctttccgatttcgacccgaccgcccatgacgtggccccggccgacatgctgcccctggaccgctacgccctggaggccgtggccgccggccatcagcgtatggccgaagcctacgaggcctacgagttccacaaggtgttccacaccctgcacaacctgtgcgtcaccgacctgtcggccttctacctcgacatcttaaaggaccggctctacgtctcggccggcgcttcccacgagcgccgctcggcccaggccgcgctgtggcgcatcctgcgcgtgctgctcctggacatggccccgatcctgtcgtttactgccgaggaagtcttccgccacacccagcccggccagcgcgggccgggcgcgtccgtcttcgccatggagcccctggacgttacgggctggcggctggacgaggccctgcgcgaacagttggacatcgtggccgccctgcgggccgaagtgaccagggccatcgaaccccggcgcaaggccggcgaggtgggccagtccctggagacggccatttcgctctatctgcccgaggacgtgctggcctcggtgtcgggcctgggcatggacctgcgcgaggtgttcatcgtctcccaggtgacgctggtcccggccgggcaagccccggccgacgccgtcgcctgcgaagccgtgtccggcgcgtttgtgggcgtggcccgggccaagggccagaaatgcgcccggtgctggatctacagcgaggaaatggccggcccgcagcacccggacctgtgtccgcgttgcgccgccgtgttggccgccgagggaatctagcccatgcgtaaaagctatcggatcgccctgcccatcgccgtgctggtggtcatcctggaccagctcaccaagctgtggatccaggaccacatggtgctttacaccacccgcacggtgatcccgggctttttcaacatcgtccacgtgctcaaccgcggggcggcgtttggatttctcaaccgctccgacatccagtggcagacctatttcttttttgccgccaccgccctggccgtgctcatcatcttccacttgctgcgcatggcccgcgatgacgacaagctgctcatcaccgggctgggccttatcctcggcggggccgtgggcaacctcatcgaccgcatcaagaccggggaagtcgtggatttcctggacttctactggaaaacctttcactggccggctttcaacgtcgccgatatcgccattttcctcgggtcgctggggctggtgttcgccttctaccgcctgcgccggccgccccaggattcctgacgtccgcccgggaagggaagccgtcgttttgacttaaacagcgttgcgtcaacgagtcgccagagcgcctggcctgccggccgcgccgggacgccaggcgaaaactccagaggtcgtccatgattctgcctgaactgccagccatgaccccgggccaactggcccttttcctgggcctgatggccctgcccattcttcccaatttccttgcgatatggcacagcttctaccgggtgttccccacccataccgagaagatgttctggttccttctggccattttcgtgcccgtgctcggagggatcgcctatctcatctggggacgcaagcgaggtcataaaccgtcatgaagatgcgccacgatgctgctgcggccttggccgccgtgatgctcgccgccctggtcggcggctgcgctccggcccagcccaaaggccccgcgcccctcaataccccggccgacatgtgggccgaactggaaaacgccaagggcgaaatccgccgtttgaacgccaaggtcgaggaactttcccagcaggtggacggcaaccgccaggaccctgaactggccgggagaatcacccgtctggagggtcaggtgagccgcatggcctcccagctggccattgatgtcgatggcggcggcgcggcccatgccccggctgcccaggcaggcgcttacgccccagcgcccgcggccgccggatacggcagcgcgccccagaccaattacggcccgggagccgcctacggcgggggccaaggccagcctgcctacggcgcaggacagggccaggccggttacggcgctgccaacgacgagcccagcattccgccctacaatccccagaccggttacgccgccccccaggctccggccgcgcccgcgccggccgcgccggcctcggacgcccaaagcccggccgacgccgtctacgccaagggcctgaccagctttaatagccgccaataccagcaggccctgggcattttccaggagttcgcccgcaacttcaaatccagcccgctgatggccaacgcgatgttctggaccggcgagtgctatttccagctcggcgatttcgccaacgccgccctgtcctaccaggaagtcatcgagaagtaccccaagagcgccaagcacgccgacgccctgttcaaacgcggcgtggccttctccaagctcggcaacgccggcgcggccaagctgtcgttcaaggaagtcatcgacaaatacccggactccgctttcgccgcccgggccaagaccatgatgcccaaatagggccggccaggagctgccaatctcatggaaaatcagccaacaacgtatcgcaaggtcgtctacctgacctttccccccgaatcttcgggcaaaccgctggtctgcgatctggcccgggtgcatggcctgagcttcagcatcctcaaggcccagatcaccccgcgccaggaaggccagatgaccatcgagatcacgggcgagcgcgaggcctacaagcgcggcgtggcctacctccaggagcagggcgtgggcgtggccccggtggcccagcgcatctcccgcgacgaggacagctgcatccactgcggcatgtgcacggccctttgccccaccaaggccctggccgtgaaccttgagagccggctggtggtcttcgacggcgaggtctgctcggcctgcggcatgtgcaccaaggtgtgtccggtgaaagccatggagatcctgctcgaaaacggcgtcatgtgacgcgggagacggccgccgtggaagaaaaacgcacctacatgcgcatccccacgcgactgcgcgggcatctgcgtcttgtgccaaacgcggacgaaatgccgctttaccgggaaacgccgcccatgggatccacgccctgcgccgtggacccgcgcgatcccggcatcagtgagccgcttttttcgttgctttgcaccatcaattccaagctcgacatgctgctggccatgcaggatcgggacgtgctggaaacggacttcccggtgaccatggacatcacggaaatcagcggggccggggtgcgattttccactacggaagagctgtccctggagcagccggttgaagccgtcattgtgctggcgcgcttccccatgcgcctggccggggccatgggccggattatccggcgcgaggaaatcgacggtcaagtggtgtatgccttggatttcacgcgcatccgggaacgcgacctggagagcatcgtgcaattcgtctttcagagccagcgcgacgaccttcgcgggaaaaagtgggactaggccatggtcaacgacgacgaactgctcgaacggctgctggaaaagatcgtccaggaagtggtgcccgacctgcgcgagagcatcggggccaccattgagaaggaagtggccaggaccttgtcccgggcgcttttggaaagcgaattccacaagcgcctgaaccaggagatgcgcgacggcctccaggacatctataaagagattgtccaggcggccaagcacggcgccgaccagtctgccgaagccgacggcaacagacaccaggccgaccagctctttcaagaagcggcccagcagctcgacaatatcctccagaccacggaatcggccacgtccgaaatcatggacatcgtcgagaagcacatggaactgcaagccgaatgcgccgccatcctcgacggcctgcccggcggctatgccggccccaaggaagtcacgcggctcaaaagcgccaacgaggcccttggcgaagacctcatgcgcatcatgacgaccctaagcttccaggatctcaccggccagcgcatcaagcgcatcatcacggccatcaagaaggtcgaacagatcgtcctggatctctatctttccacgggcttgcagatccgcgcccaggcccaggccccggaccgcaacatcgaggacctcaaagccgaggccaagcagaaggtctccgaactcaaggggccgcagtccgacgtcaaacagggcgacgtggacgacctgctcgcccagctcggtctggactaggcttcgagacaacgaaacgccaagggcgcgtcgggctattctagccggacgcgcccttttttattgaagagcttcccgtttacacgacgaccacccggccgcctgtcgcgacaactgccctttcgtcctacgattcctccccttgcccctggaaacctttcttggaccggcggcttcagtcgcccaacccccaccgacccaagcaccacgcccccctttacccttttcccattcagggggtccggggggcttagcccccggccgccggaggcatcttcctcttctgtcaatgatgatgatgatgatgccggtcccccagggggtggccgtggacgtggcggtggagcacgaagtcgggatcgcgcacgagccggccgtgctcgatggaatagtaggtatcggtgacgtgggccaggaaatcccagtcgtgggagatgatgatcatgggtttggccagttggcaaaggatagccaccaaccgctcccgggtttcggggtcaagaccgccggtcggttcgtccaggagcagcgcctcgggctccatggccagcactccggccagggacacgagctttttctcgccgccggacagcctgtgggccagacggtcggcaaagccgtccaggccaagaagcgtgagggtccgctcggccaattcccgggcggcatccggggccaggcctcggttgagcggcccgaaggccacgtcgtcaaggacggtgggatagatgatctggtcgtcggcgttttgcagcagcatgccgatccccaggcgcacctcgcggaaatcgcgctcggtttgggcctcgcggcccttgtagcgcacgatgccgctttgggggcgggcaagtcccatcatgacgtggagcaaggtcgtcttgcccgagccgttggggccaaaaaggccgatgcgctggcctggggaaaaggtgaaatccagggcatccagcaccggctcggcggcgggataggcgaaggtgattttttccagtgcgagcaacggctcaggcatgtccgctccttgaaatccagtcgccgtaggccgccaaagccgccgccagcgccatgagacagaggaaaaccctatccggccagccggcgcggaatcggtcgaggcttggaaacctgccgtggaaaccgcgcagcagcatggcctggtagacccgctgggagcggtcgtaggcgcgcaccagcaccatggctaaaagggcggcgtacgtgcggtaggtgcggccattggacgccggggcaaagccgcgcagccgggcggcgacgaccagccggccgtactcctcggcaatgacgtgtaggtagcggtaagtgaagacgaagaggaaggagaacttggccggcacgcccagggccgtcatggctcgtcccagggctggggccgggatggtggccaaaagcgaaagcacgcagaaaaaaacggagttggctttgaccgtggccagcaaggccagatcaaggccctcccgggtgacggtcagaccgtgaaatgtccagaccggctcgcccggcgtggcggccggcacgaagagccacaggaaggcgacaaagacgttgaccgccgccgtacggcgcagcacgacgccaagaggcggccgggaaagcagcgtcaaaaggagcccgaggccaaggatgcccagcggcgcggccagcccctgggccagggcggccggcagggacaaaagcaggcaggcggccagccggcagcgggcgtccagggcgtggatgggggatacgccccgggccagtggttcgtcgatcatgggcggggctttttgcccttggccgcgaaataggccgcgataccggccagtcccaccagccagcccaggccgccgatgatttcggtcaaccccgggcctttttccttttcgccagcgagcagggatcgtagtggcgcgattttcttctccacagccgcttccacgatgcgctccagggcggcggcgtccagggccggaacagcggccccctgccctcctgtctgagtctgggccgacacgacggcgaccgggccggcggctgctaccggtccggccggcggactcgagggagcggacggggcaggcgtcgcaacgggcgcggccgaggtcatcggaacgtcggccagggcggcggacaggtattcggccgccttgacctcggtggcgttctgatgcccttccccggccttgaggacaatgcgcaggtcggccttggccgcgcgcacggccggaggcacggggaaacggaaccctcccttctcgtcggtcttgccggacagcagcgccgcgccggaagcggcgtcaaagacttcaatttcgccgaaacgcactcgttccgagcggctgtagctgcattccacgacaacgtcattgccttcaacgtaggcaaagacgttgacccggtgggccaaggccggcgcggccaggacagtcaacagggccagcgaggcggcaatgggttttattcggtgcaggatcatattttatgttagatcccaaagtgttagcgggttagagcctgggccagcaattccggccggaccttggccagaaagcccacggccatggccgtgacggccccttccaccagcatgatgggcacatgggccaccacaatggccttggccgtggccgcaaagccttcaccagacagggccagggcgcaggccgtgagcagcgcggccaagagcacggcgaaaaatccgcaacaaaacgcgcctacggcccgagccttgccggtgcggcgcaaaagcggcccgaaggcgaaggcgcaagccacggccggcccggccatatcgaagacattggccccaaggacgataagcccgccgtactgaaagagcacggcttgcagcagcaaggccacggcgatggccgggaaggcggccggcccgaggatggccccaagcagcccgtttaagatcaaatgggcgctcaccggcccgatgggcacatggatgagcgaccccacgaaaaacgcggccgacaggatggccacggtcatgagccggtcgtaatccaggcgcttcaggccaagcccaacgccgacggcggacaaggcccagccgccggccagcaccggcccggaaagcaccccttcggaaatatgcatggcatccttgtccggttaggcttgcccgggggcgaaacagcttcgtccccgggcaagcgcgccgttttacttcttcttgcgcttgggttcaacgaacttggtccataaaaccgccccgcgctcgacctttttggccacgccgtccttctggatggtttcgggcgcgtcaaccagggcggcaaaaccccaccagccggcaaaaggcacggcgtagctgaagacgccgttcacgtcggtcttgaccacctgagcgaccatgtactcgttgggggcctcgtaggccttgtccttattgtagaattccacttcgaccggcacatcggcggccggcttgccatcgacaagcagtttgcccgtgaaaacgttgcccgcgtagttgccgaaggggcgggtcagcggcacaatctcggcggccagcccgacgggcgcgtcccagccctcttcctcgccgaaagccggcaccgtcaccttggtcaggtgctcaatgaacttgtcctcggccggttcgaaatagggttcgggcacgagaaaaaatgtgcccacgcccggctttttgaacgtgtactcggcggtccaggcggcgtggtccataatcttggccggcttgagggcgggcagcagatcggtcttctggccgttgtccacgacgccgaaggccttgggcttggccatgtccatgccgttgccttccatgggatgggaaaacgacaccgccagctccaccttggccttggccttgtcggccaccgtatcctgggacgggatgaccatgccgaagtgggccagggccgggccggcagacaaggtcagggcggcgacagccaaggccggggcaagggccgaggcaaggaaaaatcggggtgtgcgcatgactgggtctccttagcaaaaatgtgccagtagtggaatacgaaacaccgtcttgatatgcctgtatgcgacaaaattcaatatcgtagcacgatatggtgaataaaaaaattaaaaaaattttatttgtcagatgtattttaaaaaaagacggccagacgcagggccacgtcgggctggtcggcgggacggatgctgccttccagggtcagcccggcggccgggcgcacggccagggaaaggaaagggacaacgagggaacgtggttcgtagccgtagcggctgggcaaggcattgagggccaggatggcggccagggcgttgcccgtcgcgccggcaggatcggcgtggtgggtcaggcgcttgtccaggcgaaaggcgacaagcgaggctccggcggcggcttccaccggaccgaagtcgtagccgaggcgggccgtggcctcatggctggtccaggaaaaaaaggcgtcccgagccgagggcggcgtgcccccgccggaccggttggctccctcttcccgggcttccggggcggcggccgaaaaaaaggcgtagtcgaaccgggcaaagacgcccgctccgggctggcggcgcaggatgagccgggcgcacggcccccagaggaaggccggccgggtttcccaggcctcgtacacgccctgctccacgtttttggcttcgaaccggcccactgacgccccgacctgaccgcccagggccaggacgacttgattggtgtccaggaggcgatagacggcttcgacgtagccccgttgctcggtccagttgcggacccagccgccctgctgcggcacgaaagcggccgagggcgtaaacgacgtcggctcacgcatatcccggtagcccagagtccgggcaatcagcgacacctcgaaccggtccgcatcggccagcgccggtgtcggctggcccagggccaggatgagcgccagccccatgcaccagcgggccaagcgtccggcagcgcggccagtcgcaacctgcgcgtgacagcgaagtcgggatggcaacagactggacgccatacggggcgatccggtggcaaggcggcaggcgacgggcgattccatggctctttctgccacgatcagcgctgggagaaaaggtggtccgaggcctaggaggggtcggccttggccatggctggccgggattgggtcgccgtggccggcacgaagcgcgcgaaccagtcgaggttgcggaccatgagatcgcgcaacagccccgtttcggtgatgtcgtggccgcttcggggataggcggccagcctcgtggtcacgccgcgacgggacagggcggtgtagagttccagggcctgggtgaaggggacgcgctcgtcggccacgccgtgctggaacagcgtcggggtttggatggcagcggcgtatttcagcggcgagcggtcaaacaggaaatcgaagcgctcgtaggcttcgccgcccatgtacagcggcatgaaatcgggcaaatccatgctgccgcactggctgaccagattggtgatgccgccgccgatggaggcggccttgaaccggtcggtgtggccgatggcccaggcggcgagatagccgccgtagctccagcccatgacgccaaggcgctggggatcggcttgccccttggcgatgagcgcgtcgaggccggacatgaggtcggcgaaatcgaccccgccccaatcattgacgatggctcggcgaaacgctggcccgtaaccgtcggagccccggacgttgggctgaaacagggcatagccgtgggcggaaaatacggccagggggtagctgttgagcaggccgggatagaggcgctgggcggcttgggccgggccgccgtggagttcgaccagaagcggcggcgcgccgaccacaggcccagccggcggggtatacaggccttcaatcatggtcccgtcagccgatttccagcgcacgatctcgggcttgaccgtctggtaggcggcaaattcccggttgacggcggacacggccttgggctcgtagcgctcgaccgaggtgacgaaagcctcgggcggcaggtcccaatcggtgagcgccagccccagatgtcgggaaccgagggacagactggcctggagcggaatgcgtcggccgtcgtcaaggcgagtcgtgggctggccgtccagaggcagggcatagagcgcggcccccacgccgtcggcctcccgcacgagcaggctctggccgtcctcggcccaaccaagaagttccggccgggcgtcgggggtgggggccagggggcgcgactcgccgccagtcaggggcacgaccatgacccggccggcgttataataaaatccgggtgctgccgtggccacataggccaagagccggccatcgggcgagacggtcggcatgttttcggaggcgtctgaagcggccacaagctttacgccgcccttgtcaagatcgaccacggcgatgtcggcatggccggcgtccaccggagccgtcccgccggcggcgccattatgggcgcgcccccggggcggggcgtgggggttggcagtttcgaaaacgatgcggcggccgtccggggaaaaggcgaacgcacccacgtcccggtcggcgacaagctggcgcatgaccccgggttgcgacagggtcaggaggtagagcccggccagtccgccagggctgtccagcacctcgacgtcgccgtcgcagccctcgggacggtttggcccggccttgggactggtcgtggcggtgacggccagtttcttgccgtccggggaaaacgccagatcaaggatgtcggcccggccgtcgcttaagcggcgcgattggccggcggcgagctggagcaaatggagctcggaggcgttatcgccctggcagagataggccagccatttgccgtcaggggaaaaacgcgggtggtcgcaggaggtcgtggccggggtgaccggacgcccaccctcccgggccatgtcggtcaggacaatgcgtgagacaggttcgccggcctgatcggacattcgggtcacgacaaaggcgacgcgtttgccgtcggcggctacacggacatcgtcgattgaggccagacgcagcatggcctcgatggtgaacggcttgtcgccgccggccatgacggacacggccggcgaacagaacgcaaggaaccccaagagggccaggacgacgcacaagcgttgggacacagggacctcgcttctcacgatggccggcactctacggccccttgacccgccggtcaaacgccgaaacgacgacggcccccttgcgggggccgtcagaaagacaagtatctgaaatcactggtttagatgcgaagactcgcctcggccggccgcttggacagccacagatcaaagagaaagcgcgtaaagaagatggccgtgaacatggaggccacgatgccgagaatcagggtcacggcaaagccccgaatggggccggtgccgaactggtagagaaccacggcggcgatgacggtggtgacgttggcgtccaggatggtaagcgtggcccggctgtagccgacgtccacggccgaacgggcggtcaggccccgtcgcagctcctcacggacgcgctcgaagatgatgacgttggcgtcaacggccatgccgatggtcaggatgatgccggcgatgccgggcaaggtcagggtggccccgaaaccggccagaccggccacgatgagcatgaggttgaaaagcaaggctgcgtcggccacggctccggccacgccgtagtagacgatcatgaaggcgatgacgatcaggccgccgatgacggccgaatggacgcccttttcgatggattcctggcccaaggaaggaccgaccgtgcgctgttccaggatggtgaccggagccggcagcgcgccggcgcgcagcacgatggccagatcgcgggcttcctcggtggaaaaccggccggtgatgctggcccggccgccgccgatcttttcctggatggtgggcgcggaatagaccttgccgtcgagcacgatggccaactgcttcttgacgttctcggccgtgacccgttcgaactgccgcgcgccgctgggagtgaaggtcagggccacgtaggcttggttgttggggtcgaagttggcccgggcgtcggcgatgctctcgccggtcatgacggcgtcggccttgagcgcaatgggccgctccaggtaggagccgtcgggattgcggtggcgcagcacggacaattcgtcgcccgggggcaggatgcccttctgggctttttccatgtccacggtctcatccacgaccttgaattccaggtgggcggtcttgccgataagcttgatggcccgttcagggtcctgcaggcccggcagctggatctggatgcggttgtcggcctgcttgcggatgtcgggctcggccacgccgaattcgtcgatgcggttgcggatggtcttgacggcctggtccacggtcatgcgggcttggtcgtccttgtagcgctgggtgaacgacagcttgtagaggagcttgttgtccgcggcggattcgacgccatcgacgtggagcacggaaaagtggctggacaggaacttgtccagggcgtcgcgcttgtcgggggtggccaggacgaactccaggcgcttgccgtccgggctggtgcccgggcgttggatgacgatgccctcatccttgacctggtcgcggacgtcgcggcccatctgggccagggaattggccagggccttgtccacgtcgacgccaagggtcaggtggatgccgcccttgaggtcaaggccgaggctgatgacgtcatcgggcagaaatttgcccagaaagctctgcttgaccgaccccagggagggcagcatgtagatgaggcccagaaaggccacgagactgatcacggccagtcgccaacgcaggtttccagtcatgggcgaggctctccttgggaggcttgcgcttgggagtcaaacgacaaaacgaagggactgccagggcagcccttcgccgtcgcttcgggcctttcggcccgaagtggagtattcctaatccttggacttgtctttgcccttgggctcggccttggcggccgaagcgccggcttcgccggggccggagacgaagttgcggttgatctcgatattgaggtccttggcgatctcgatggtgatcttgtcgccgtggacttccatgatgcggccgtagatgccgccgccggtcaggatgtagtcgccgcgcttgaggccggccaggtattcccggtgctgcttggccttcttctgctggggacggatgagcaggaagtagaagatggcgaacatgaggataagcggcaaaaaggcggtgatggggttgccccccgcggcgtcgccgccgggcgcggcgcccatggcgtgcgccagactcggaaacagcatgatgcctccaattaggatgatggtgccgccggcgactgggcgcgcttcgaacgtccgaagcgtcgcgccgtggccgggacgcgtctatcgcgccaaaatggatggtctaaaatcgccgtcgcgtcaaggccatttgcgcgccaaggccggctggcgcccgtcggttgttcggcctcagggccagggcgtgcattcacgagccggcgcatacccctggtcaaacgcttcgccaagggtcggcagggccacccggttgcgtcggccgatccgggccgcgtccgggcagcccgggccatgaaaacgatgtgacgacgcattgccgacatagggcgcggccgggggcggcagtgatagcaggcgcggccaaaccccctgcccactggccatggcccggcgttggagtgcgagctgccggtcgaaaatagtcggtcccacatcctggtgccaaaagacaaagacgcaacccatggagagcaaaatttccgtcacgctgcgtccgtccggcaagacgagatcgcccagcagccggccgaaacggtcttggcccgacccaactccaacaaaccgcaacggcacgccccgaaccaacccttccagggccgccttggcctggtcggcgaaatactgggcgggccggccctcatgggcggtttccggggcgtccacgccggccagacgcagggtgcggccatctgccagccggcaggtgtcgccgtcatagacggcgaccacacgcaccgtctcctcagccgctctgaccgtctgcgccaagcccgccaggcaaaacgccgccagcgccagcacggcccaatgccgtcgccctccccttgccatgaacgtcctgccttccataacgcctccaaaacaaacggccgccgcgaatgccgcgacggccgtttgccaaaaagcacagcggtctggccgctacttcatggctccgggaacaaagccgatcttgtcgatggcggccttgatgtcgtcctgcggggcttcgccctcaaaggacaccaagcccttgcccaggtccacggaaacattggacagccccggcagggccgagagcgccttggtcacggaattggcgcagttctggcagtgcatcccgccgacttcaatggttggcatcaggcgtcctccttcgctttttcggcgatataggccagggccgccggaaaatcgagggtgccctcgtagatggcccggccggaaatgaggccttcaagaccctttttcccatagggataaagcgccttgacgtcgtccagggtggccacgccaccggcggcgatgaccggcaggtcggtgagttcgagcagccgctgcagcgccggcagattcacgcccgactgcatgccgtcgcggctgatgtcggtgtagaccacaaaggccgcgccagcggctgacaggcccggcagcacgtcctcgacggtgcggccggaatcctccacccatcctttaactttgaggttgccgtccacggcgtccagggagacgcccacccggccgggatgggccgcgcagatggcggcaaacgcgtcgggatcggccaaggccagggtgccgatgatgagccgtttgacgccggcctcaaggtaggcggcggccgtggccgcgtcgcgcaccccgccgccgagctgcaccgggatggacaaaccggagcagatgcgggcgataaggtcgaagttgcgcggcttgccgctaaaggctccgtccaggtcgatcaggtggagccatttggccccaagcccttcccaatgccgggccatagcctcgggatcgggggaaaacacggtgacggcgtcggccacgccctggcgcagccggacgcactgcccgtccttgatgtcgacagccgggaaaatgatcacaacccaagctccgcgatgcccttcttgaggccttcctgggccagctccatggccgagagccaacggccgttgcgggagacgaacttcttggcgtccaggatgttggaaaccagggactgctgggtctcgtcaaagtggaagttacggaccatggccccggtgcgcacatcgatcaggtacagcacgaaatcgacgctggccggcttggtggccccaatctcggaaccatcgcgctcgcgccagtcaatgaccatgggcacgacgacgtagtccgcgccagcgcacttgccgatgttgacgtaggaacgcagggtccccagccgtccgggctcgtcgccgcgcggggcggacttggcgcaggaagcggccatcttggccggcacgaactgctgcttggccccggccagatcctgctccaaggcagcgtcgaggtggaccggagccacctcgggcacatggcgggcgactggcaggtagccggcgagcaagtcggcgtcggtggccgggatggcaaagggcaacacggcgaactttttgtccaggaaggccacggccgaggccggggcatcgcccgaggccggagccttggacacaggggcggtcttgcgcacgcagccggcggcgaggcttaagcccaaaagcgccacgccgagataggccagagatttgcttcgcatcagtccaggctccctttggtgctcggcaccctgctcgatccgtgcgcggccgtggcccggcgcagggccagtcccaacgccttgaaggccgcttccaccagatggtggccgttttggccgtacacgaaatggatatgaaggttcatgcgggcggaaatggccagagacttgaagaattcccgccacaggtccttttcctcgccggcgattaccggcggcaacacatcttcgcggtagaccagatacggccggcccgagaggtccaccaccacgtcgcacagcgcttcgtccatgggcacccgggcgtcgcccacccgctctatgcccacgcgctcgcccagggcctgacggaaggcctcgcccaggcagatggcgacgtcttccagggtgtggtgggcgtcgacctccaggtcgccccggcaggtcagattgaggtcgaagccggcccagaaagccagcaggttgagcatgtggtcggcaaaaccgaagccggtgtcgatggcggcgttgcccttgccgtcgatggtgatctcgacggccacgcgggtttcgccggtctcccgggaataggctccaaagcgtttggccatgacggttccccgaccagctaagcggtcggggcctccttggcggcgtccttggcggcggccggctgggcagctggggcggccgtggcgttttcgggatgcagctgtttttgtgcctcggcctgtttctgttcgcggtccgcccgatccacttccgcttccagggtggatttgacgtcgctgctcatgcggcgaaactcggccatgcccttgccaagcgtcttcatgagatcaggcagcttggaggggccgatgacgatcagggccaccaccaggatgaccagaagttccgtggaaccgatgccgaacataggactactcttttggccgggcgcgtatggtccgggattgcgtcgcgttgcgaccgtctattcccactcgatggtcgcgggcggcttggacgagacgtcgaacaccacgcggttgacgcctttgacctcattgatgatgcggttggacataacggccaggatttccgacgggagacggctccagtcggcggtcatggcgtcgagactgtccaccacgcggatggcggccacgttttcataggtacggccgtcgcccatgaccccgacggtcttgagcggcagcagcacggcaaacccctgccagaccttgcggtaccagcccgaggcgacaagctcgctctggacgatcttatccgttcgccgcaaaatctcaagccgttcctcggtcacctcgccgatgatgcggatggccagccccggtccggggaagggatgacgccagatgatgaagtcgggcatgccgagctccaccgccaccttgcgcacctcgtccttgaacagttcacgcaggggttcaataagcgccagcttcatgacctcgggcagcccgcccacgttgtggtggctcttgatgaccgccgagggtcccttgaaggatacggactcgatgacgtcgggatacagcgtgccctgggccaggtacttgaccttgggcaacttggccgcttcgacctcgaagacctcgatgaaggtcttgccgatgatcttgcgcttttcctcggggtcggtcacgccggccagcttgtcgagaaagagtttggcggcgtcaacgtaatgcagattgaggtcaaagtgttcgcgcagataggcggccacttcctcgccctcgcccatgcgcaaaagaccattgtcgacaaagatgcagtgaagcttcttgccgatggccttgtggagcatgacggccactaccgtggaatcgacgccgccggacagggcgcagaccacttcgtcgtcgccgactttttccttgagcgaggccagctcggtttccaggaagctcgacatggtccagcccgaggtcaggccggcgatctcgaacaggaagttgtggagaatgcgctcgccgtcctcggtgtgggccacctcggggtggaactgcagggcgtagatgcgacgggaagcgttggccagggcggcgatgtccacgtttttggtgcgcgcggccaccacaaagccgtccggcgcggccatgaccttgtcgccgtgggacatccagacgatgtgcccgtctttttgcggcaggccggcgaaaaggggcgtgtcggccaaaagctgcaaatcggcccgaccatactcgcggtcggtggaggcggccacctggccgccgggcaggtggtgggccaacagctgcatgccgtagcagatgcacagcatgggcaggcccagatcgaacacggccggatcaaagggcggcgcgtcggcgtcggcgacgctggaagggccgccggacaggatcacggccttgggggccatggccgccacttccttggccgtgacggtgcagggatggatttcggaatacaccccggcctcgcgcacgcggcgggcaatgagctgggtgtactgggagccgaagtcgaggatgagaaccttgtcgggctggctcatgctagtaggtctccacgcggtagttgggggcttccttggtgatgatgacgtcgtggacgtggctttcgcgaagccccgccggcgagatgcgcacgaaccgggctttttgctgcagctcctcgatggtgttgcagccgcagtagcccatgccggagcgcaggccgcccacgagctggtagatgctgtcggtgaccgggcccttgaaaggcacccggccgacaatgccctcgggcacgagctttttggtcttttcctggaagtagcggtcggagctgccctcacgcatggcgtcgatggaacccatgccgcgatagatcttgtaggtgcggccctggtagagcacggtttcgcccgggctttcctcggtgccggcgaaaaggccgcccatcatgaccgtgtcgccgccggcggcgatggccttgacgatgtcgcccgagaacttgacgccgccgtcggcgatgatgcgcttgccggcttcacggcaggcccgggaggcttccatgatggccgttacctggggcacgcccacgccggccaccacgcgggtggtgcagatggagcccggcccgatgccgaccttgacggcgtcggccccggcggcaatgagcgccttggccccttcgtaggtgccgacgttgccggccacgagctggcagcccgggtgctcggccttgatggcccggatggactccaggatgttcttggaatggccgtgggcggaatcgagcaccaggaagtccgcgccggcgtcgagcagagcctggacacgctcgccccggtcgccgcccacgccgatggccgcgcccacgcgcagccggcccaggctgtccttgcaggaattgggatatttgcggatcttctcgatgtccttgatggtgatgagcccgcgcagcttgttgttgtcgtcaacgaccaggagcttttcgatgcggttggcgtggaggtggtgcttggcctcctccagggtggtgcccacgggcacggtgacgagatttttgctggtcatgacctggcccacggtggtgaccgagtccttgacgaagcgcacgtcgcggttggtgacgatgccgaccagggtgtcgccgtcgaccacgggcaggccggaaatgctgtattcgctcatgacggtgagcgcctgctccacggtcatggccgggggcacggtgatgggcgaaatgatcatgcccgattccgacttcttgaccttctccacttcgagccgctgttgggcgatggtcatgttcttgtggaccacgcccacgccgccgctacgggcgagctggatggccatgcgcgactcggtgacggtgtccatggcggcgctgaccaggggaatgttgagcttgatgtccggggtgagccaggaggacacgtcggccaggtcgggcgtgacttccgagtaatcgggaacaagcaaaacgtcgtcgaaggtgaggccgaaatcgatgactttttccatatcgcaaactccgggttatatgggcggcctagtccaggccgagataagcggaacgcaccttggggttgctcaggagctccttgcccggcccttccagggtgacatggccggtttccaggacatagccccgatgggcgatctgcagcgccatctgggcgttttgctccacgagcatgaccgttacgccatctttgttgatttggacaatgatctcgaaaatgttttccaccaccagcggcgcaaggcccagggacggctcgtccaagagcagcagcttgggccgggccatgagcgcccggccaatggccagcatctgctgctcgccgcccgacagcgtgccgcccatctgggaacggcgttcgcgcaggaccgggaacagcgaataggcgtggtcctcgtcgtcgcggataccggccttgtccttgcgcagatacgcccccatgagcaggttttcccgcacggtcaggcgcgggaagatcatgcgtccttcgggcacctgggtgatgcccatggagacgatgcgctcggtggtgctggcggtgatgtcctcgcccagaaaggcgatggatcccttgcggggatggaccacgccggagatgctcatgagcgtggtggatttgcccgcgccgttggcgccgatgagcgtgacgatctcgccctgggcgaccttgagggaaacgccctttaaggcctggatgttgccgtaaaacgtttcaatggcggtcagttcaagcatgggccgcccctttgccgaggtaggcttcgatgacgtcggggttggcccgcacttcctggggcgagccgtcggcgatcttgacgccgtggtccaggaccaccaggcgcttgcagatgcgcatgacgagcttcatgtcgtgctcgatgagcacgacggtgacgccccggcccagaatggcgtggatgagatcgaccagggcctcggtttccctgggattcatgccggcggccggttcatcgagcaggatgagcttggggtcggtggccagggcccgggcgatctccagccggcgctggtcgccgtaggacaggctggccgccggggacagggccgtctcgccaagccccacgaaatcgaggttttccatggccgcgtcgatgatggcccgttcctcggcccgctgggagcgggtgcgcagcaccgagccgaagaagttggccgaggtgcggcagtggcgggcgatgcgcacgttgtcgagcacggtcagcgccgaaaaaagccggatgttttgaaaggtccgggccacgcccagggcggtcatgcgctcgggtttgcggccggcgacgttttggggctccccttccccgccggcaaacagaatgcggccgtcggtgggtgtataaatgccggccacgcagttgaacatcgtggttttgcccgcgccgttggggccaatgaggccggtgatggccccccgctccacggtaaacgacacgtcgcttagggccataaggcccccgaagcgtttgctgactccgtctacggtaagtatcgcatccatattacgccgtccggcgcgccgcgatcctggcgcgcaagtcctttatcagactgctttgcatggtcgattccgccacctgggtgaaaaggccgtgggggcgaaagcgcatgatgaccaccatgatgaggccgtaggccagaaaccgggtttcggccggcagcccgagtttgggcagggccacccgcaacacttcgcccagggcgatgaggatggtcgaaccgaccagcgcgccccgaatgttgcccaggccccccagcacgaccatgcacaggaccaggaaggattcccagaacttgaacatgtccggcgagatgaaaagggtccaccgggccaaaaacgcgccggccaaggccccgatgccggtggacacggcaaaggcgatgaccttgtaggcgaagaggttgaccccgcaggaagcggcggccatggggtcctcgcgaatggccagccaggcccggcccaggcgcgaatcctccacccgggtcatgaccacaaagacgagtcccaccatgaccatggccagatagtagtacgggacctcgccgcgaaaggcgtagcgccaccgctcgtccacgccaagcagggtcgccagccaagtgacgtcgagggaaatgggggcgatgccgggaatgcccaaggggccacgggtcagccagatctcgttggtgaggaaaagcaccacgagttcggaaaacccgaaggtgacgatggcgaaatagtcgccgaccagccgcaaggtgggcgcgcccaaaagcaccccaaaaagcgcgccgtttaagaccgccagagggacgatcagccaaaacgacatgttgtagtggatggtgagaagcccggccgtataggccccgatgccatagaatcccacgaatccgaggtcgagcaggccgcaaaagccgggcaggatgttgagccccatggccagcaccatgtagaccatgatgaggaccaggacgtgcaggacgtaaacgtcccggaaaggcatcagcggataggccagagccgccgccagaagcaggtatttgagtgattgtgccgcgccgcgcatgtgtgttccagtcggttcgaggcggccggcgacggccgccggttgctaggctttttccgtcacggcccggccgagcaggcccgagggacggaagatgatgaccaggatcatgacggcgtaggcgacgccgtcgcggtagggcgaggagacgtagcccgcgcccagggtttcggcgatgccgagcaccacgccgccgagcatggccccgggcaccgagccgatgccgccgagcacggcggcggcaaatgccttgaccccggccagatagcccatggtcgggtacatggtgttgtagtacatggacaccatgatgccggccatggcccccatggccgagcccagggcgaaggtgaaggagatgacccggttgacgttgatgcccatgagcgaggcggctgtctggttctgggccagggcgcgcatggccgtgccgacccgagtgcgggtgatgatgaggttgaggccgaccatgagcagcagcgccacggcgtagatgatgacctgcatccaggagatggtgacgtcggaaaaggtcagggccggttcgctgaaaaaggcgggcagggcctgcttgggaaagggcatgggccggctgccccagatgatcatggccagattttgcagaaagatggacatgccgatggcggtgatgagcgcggccagacgcggggcctcccgcagggggcggtaggcgatgatgtccagcagcacgccgatggcggcggcggccagcatggccaaaagcacggccaggggcagcggcagtcccatggaaataaacgacagggtaaggaaagccccgagcatgtaaatttcgccgtgggcgaaattgatcagctcaatgacgccgtagaccatggtgtagcccacggcgatgagcgcatagatgagacccagggtgaacccgttgacgagctgttgttcgagcaacgtctgctccgaagcgtttggcgttgagaggggcatgaagcgcgaacaggccggatgatctccagcctgttcgcgttttgttcctgcggcggtttccgcctaattcatctgcttttcggccgggacgaacttgccgtccttgacgaccttgacataggcgggcttgaggcagtcgccgttgccgtcaaagtagttgacgccggtgacgcccttgtagcccttttccggggaatcaaggccagccaggtaatcgcggatcttggtccggtcggcgccgaccttggcgatggcttcggccatgatgccggcggcgtcataggcattggcgctcatccagtccacgtcgcgcttgtacttggccttgaacgcgtcaatgaacttcttggcgtcggccccggcggtctcgaccaggaagggcgcggtcaggtaggtgttgtcggccgaagcgccgccgagcttgacatagtcgaggttgtcgaagccgtcggcacccattttggcgacgttaaggccgatcttcttggcctggtcggcgatgagtgcgccttcgggatagtagccggcgatgaacatggcttcgggagcggcgcccttgagcttggtcagctgcggggtgtagtcctggtcgcccttcttgtaggcttcctcgccgaccacggtcaggcccagggccttggcttccttgatgaaggcgtccttgaggccgatgccgtagtcgttgttctcgtagaacacggccactttcttcaggcccaacaccttggccgagtagtcggccaggaacttgccctggaagtcgtcgcgataaacgttgcggaacgaccaagccttgcccttttcgtccttgctcttggtggaaatggtggtgttggtggctgtgggcgtgatggcggcgatgccttcgcgcacgtaggccggcaggccggccagatgggccgaggagcacaggtggccgacgatggcgacgatggcttcgtcgttgacgatggacgaggacaccgtggcggcctcgcggggctcgcactgctcgtcgaagtagacggcctcgagcttcttgccgttaatcccgccggcggcgttgatttcttcgagcttgaggtccacgccggccttgacgttctcgccgtagccggcggcgctgccggtgagcggcgtgggaacggcgatcttgatggtgtcggcggcatgagccggcgcggcggccaagccaagggtcaggccgagggcgcaggcaagggcggcccgggtcgtttttctgccaaacatcacgtttcctccggttgcggttgcatggggcatcggtctcggcgtccgggagcggccctaaagccggcccgggttgggtacggtcgcgttacgcggcaacattcaccaaatcgacacgaaaagcaatctcgcttaggaacccggcttcgcctcaagttcttcctgagcggttttccgcgtctcgggatcggttttgggcgaagcaatgacggcggaaagcgcctgtctggccttggcttcgtccttgtaggcgtatttgtagagcaggcccagattaaaacgcgcccggaagtcctcggcgtccttggccaggatggcttcgaaagccgccttggccccgtcgagatcctgcatgttgtagcgcaccacgcccagggcatttaagacgtcagggtcgtcgggacggacctttgcaactttgtcgagaaaggtcttggcccggtcaaaggaacccatggccatgaagcgctcggccatggccatttgcagaccaggatcgtcgggattttcctgaagcttctgcatgagttccatgacctcacgcatggggccgttcatggcttggtccatgcccccgggcatcccctgccccatgccgccgccttttttctggtggacctcaagggtcggccgctccaggcggtagatgaaggaggcggcgaagatgatcaccaggcaaaagcccatgaaggccaggaccatgcggcccgaggcgttggggccgtgttcagttgtcgtcatttaagatctccaggcgcgacagacgccgtttgagacgctgttgggaagttgccagaaaagccacgtagcagccgagaccaacccagaccaggacgttggccgcgaacaggtagacttccttccccatggcttaattccttatggaaccgtggcgcataagggccgtgacggccgcgccggttccgagttgtcgggtgcgaaaggcgagcaaggccaaccagagaaggcccatggccacgaggttggccacgacggccagccacatttcgggttccatgccaccgccctgggagcccaggaccgaaggatggatgctgcgccagtagcgggccgaaatgaaaacgagcggcacatcaagaaaggccaccacgccaaggacggccaggaccgtgtcctggcgctggccgccgacgtccgaggcccgcagcagcagataggcggcgtagacgaaccacatgaccagcgttgtggtaagccgggggtcccaggtccaccagacgttccagatgggccgggcccagcacatgccggtaataagggccagtccggaaaagagcacgcccagttccgccgccgcgccggccagccgggaataggcgtcccgacgtttggccagatagaggatggaggcgacgaagttgacgaaaaagctcaccgtggaccaccaggccaggggcatgtgggtgtagaagatcttttgcaccacgcccatggactgctccaccggggcatggaaccagatcaggtactgggcgatgatcgaggcggccgcgaaggccagggcactcaggcggatcatgcgggctattcctcgccggtatagagaaacggaaaaaggaccagggcggcggcggtgaacacggcgtcaaaggcgaccaccgtacccgtccaggcccccacggcctccagcccccgacccgagatgacagtttccaggaggcggatgccggccaggagcgccggcacgagcagcgggaaaaggatcacggtcaacagcgattcccgcgacgactttcccaccgacaaggcccccaaaagcgatcccagggcgcacagcccccagtccacggccgcgaccacggccaggcccatgagcggcgaaccggccacggtctggccaagaaaggcgaccgccgcaggggcgaataccatctgacagcaaaaaagcaacacccagccggacagcgccttgcccagccacacggcctgggccggggccggggacaagagcagccccaggcgcgccccctcggcctcttccaggccgtagaggaaattaaaaaccagcacctgcccaaaggccgtagccagccagaagacggcggcggcggccaagggcggcgagagctcgcccggctcccgggacaggctcatgatgaagatgaggagcaagcccaagagcacggtctggaccagcccctgagccccggacagggccagggacaggtccttgcgggcaatggccagggcggctttcagcatacgccctccccggccagggcggcggcgtcaaaaccggcggccgggccgtcgtaggcgacgcggtggccgtcaatacgcaccacccggtcgcaggcggccagatcggcggcgatgttgtggctcacccaggccaccgaagccccggcgtcggccacggcccgaatctcccggcgcagccacacggccgaggccgggtccaggcccgaggccggttcgtcgagcagcaacagcctgggcgcggtcaaaaacacccgggccaggctcaggcgctgggacatgccccgggagaacaccccggcttcctcgtcggcgaagccggccagccccacgcgcgcgagcacggccgtgacggcgtcgtcgtcgcggggctggccgaacatggactgccaaaaagccagattggcccgggccgtgagcttggggtagatgagcgtcttgtggccgaggtagccgatgccgccgggcggcagctcggtttccacctcgccctcgcttggcggcaaaaggccggcgacaaggcgcaacagcgtggacttgcccgcgccattaggaccgaccaccaacatcacctggcccgggaccaactccaggtcaatgtttttgagcaccgcgcgttcgccgtaaaaacggcacacccggcgcaggcggacaagggcttcggccatgggcttgagccgccctactcgcttttgccgcgcaggcggcgcaggctggcaaagggggcgaggcacatgagcgtgccgccgatccaaatccagttaatcagcggattgacgctgatcttgaggctggccgcctttttctcggtggcgctgaccagggtggcgtagacttcgtcgcccaggctcgggatggtggacacctcggcaaagggctgctcgaagccggtgtagatgcgccgctcgggggtgagcacgcccacgggcttgccgtcgcgagtcacgtcaataacggcccggctgatggccatggccttgttttcctcaaactccagatccttaaaggtcaacgtgaagccgccgatctccatggtcttgcccggagtcagcacggcttcctggttgagctggtaggggccggaaaaggcaatgccgagggtcaccagggccaggcccaggtggacgctgtaggctccaagggccccggccaggcttcgggcatggcgttggcggatgaagacgtaagcgaccgtggccatggcggcgatggaggccgcgccggcgaaaagggccacgggcaggtgtatgcccaggccatacaaaatggccccgccgccaacgaaagcgccgacggtcagccccaggccggccttgtcgcgcacgccctcggaccaggacatgagcggacaaaaggcgaccaaagccgtgaccagggcaaagagcggcaggcacacgcggttgtaaaaaccggcgtccaggccgacggggttggcgctccacagtttgctgatgaccggccacagggtgcccagaaacaccacaacggaaagggcgagcataagccaggccaggatcaccagaaagcccggcacgctcatgaggccggacaggggcttgacccggtcagcaaaaaacggcgcgccggccaggagcacggcggccaggaccaccagggtaaagagcataaaaaggagcagcggcccggccacgccgccttcgccgaaggcgtgcagggattcgaccacgccgctgcgcacgaggtaggtgcccaggatgcagctgacgaaggtcaccacggccagggccacgttggtcttggccagggccttggtgcggcgctcgacaatggcggtgtggataaacgcggtgctgaccagccagggaatcagtgaagcgttctcaaccgggtcccaggcccagtagccgccccaacccagttccatgtaagaccaccagccgccgaggatgatgccggaggaaaggaaaatccaggacaggatggcggtgttgcgggcggcggcggcaaaggaggcgcgctcgccagtcagccagccggccagggccagacaggccggaatggcgaagccggcgtagcccatgaacagcagcggcggatggaagatcatgccgggattgcgcaacagcggattgagcccccggccttcgggcaccggcggcacggcttccaggaacggattggaggggccggttaaaaggagcaggaagaaggcttcgacgacgaggaaaaaaagccagtaggcgtggcgcgtgggcgcggacaggctgcggtaggccggcgagacggcaaaaaagaccccgaaaagggccaaggtgagcatccagaacagcagcgacccggcctggccggcccagaaggcggtcagggcatagaacaggggcaagagcgtgtccgtatattcggccacgtagacaaaggagaaatcgcgttgccacagggcgacggtgaggatggccgaggccaggaccacgccggccgtggccagcaggtggcctttttcgatcattcccaggcggccgtagtcgtttcgccacagggcgaacaaggcggccaccgcgccggccagacagatgatcatggcggcaagtaaggcaaaatacgccgtaacgtgcatgaaaactcctctataaggtccccgggaacgatggcggcacggacacagggcgtcgagccgacaacgccaggggatggcaagcggtttcgcgacaattgagcatgggacggtcgcgcgtcgccgcccaaaaggcggtaggcgctcggggcggccctgcggccggcttcgcggacccgtggccggggctgtgggttagcctcggttttccttctggtacttggacggacacttggtcatgagcgtgctggccgcgaaagccccggaagcgggattgacgccaccttccacgatgacctccacgccgggcttgaaggtgtcgggcaccacgcccttgaaatcgacccggatggtcttggcggtctggtccttgtccagaagcgtgaagctgacgcccagggcgtcggccggccggtcaatgccctcctcggccacggtgccaaacagccgagccttggacagctccttgggcggcatggccaacgcttcggagacattgaggaagtaggcggtgttttcacctaggccggaatagagcagatagcccaggcccccgagaaacagggtcaaggccacgagatacatgggagtgttcttctttttcgccatggcaaaacccgataggttgaagattaggacggcatcgcgtcgtcccgggcgcgctggcgcaaaagcgcctcgcgtcgggtccgggccagttcgcgcatgtccgccacctggtcggtttcgtcaatgatttccttccccaagatctcttccaaaacatcttccaaggtgatgacgccggatacgcccccgtattcgtccagcaccacgaagagatgcatacgcgattccaggaattttaccaacacccggtccagggtcatggtgtcgagcacgaaacgcacgggcttggccagatcggtcagacgcttgtcgtcctggtcgttggccagggcttcgaggacctcgcggcggtagacgatgccgacgatgttttccgggtcgtcggcggcgtggaccgggatgcggctgtggggccacacgcccttgccctgccctcgggtctcggccacggtcatttcggccggcagggaaaagaccaccgtgcgcggagtcatggcgtcgctggcggtcttgcggtccagggacaggatgttggtgatggagagttcctccaggggattaataatcccctcgcgccgggtcaggctcaccacggcgcgcaggtcctcttccgaggacactggggttttgcgacggccggacaccagccgggccaggaacccgccggcccaaatgataggcaaaagggccaggatcatgagtttcatgggccgggcgatgaaggccgacaccggccgacagtaggccacgcccacggttttggggaggatctcgccgaaaatgagaatgacgacggtaaatatggcggtgaaaagccagaggtcgtcggagccgaatacggaagccgcagccgcgccggccacggccgcgccggcggtattggcgattgtgttgagcgtcaggacggcggtaatgggtttttcaatgttgctgcgcagggcgaaaaggatttctcccgatgcccggccgcttttacgcagccgctcaatccaactccaaggcacggaatagagcgccgcctcgctcatggagcaaaacgccgacagcacgacggccaaaccgacggccaaagccagggtcagcacgatccgcctccggtcccggggcgcttggccgggtcggcgttggcgggttcggcggaatcggcgtcaggagatgacgaggacgtgtcgtgttccatggaaaaagacaaaactccaggcgggtagtccgcgataaattgggtcgtccaccctttatacgaactcacgcgccggtgtaaaggccgccggggccctagttttgggctgcggccgtatcgtttttgattctaaacccgcccttgagcggcggaatgatgtagcgttcggtgaattcctcaataaccatgtccggcttctcgcgctcaataagcgccttgtcgaaaaagcgcagctccatctcggactggggcttgagccaaacataaagtgacttgctgaaggactcggccataaacggcaacagctcccaccagaaggaatcatgaaagatgacggccgtgggcagcttggcgttgtcagtaaaggaatactgcggcacttcgaaatagtgcggatcgaccggaccgtcgtaggacaggccgcgggccttgtaccattccttgttgaaaagcagcacccggtcttccttcaagtaatcggacagccccatcatgaaggccagatcgccggccatccaggcatactgctccaccctgaactgctcgcgcggcaagggtttgaccgccggaaaatcccggacaatgggtcccatgatctgccggtaggccgcgtaagcgccaaaagcgttccagtggctgtcggtcatgtaaaagacattatgctgttttttttcttcaagcaaagccgacgtgacgtcgatgatctcgacatgccccttggcccgcacggcttccacgaactgttcgcggtggcttttgggccgcaccggacgcaaggcctcgggcaacatctcgggatagacggaattcttgttgggggccaggatcaccagatagcgaatgccgcgttcttccagccactggcggcgatgctccagttcggtggccagcagctccaccgaagcggctggcagatcctcgggggagcgggcgtcctcgatgacgttgcgaaacgccccgtcctgggccagaaacagccaatgctccttgccggccatgaccttggaggacggcgtggtggacgccaggacaaaggtatccatatagctgttccagctgatgagcaggccgcgcaggttgtagcggcggtcgagatagccccggcgcagggcattgaaccagcggccccaggtggcgggatcggcgctcaccgacggcaagggcgcggtatcggtctcggcgatggtgcccttgggcgcgaaggcgagatacctgtccgccgttggcaggaccaacatggtcacaaacaggcacgaggccaggcaggcgatgacgcggcaaaaaaaagaagatcggctttgcaaggcgtgcgtccgtacgtcaggccgacacggcgcgtccccaggcggtccgcagcgtctcggcgttggtgagaagttgggacaagacggcctggcaaaccagcccgtcgatgcgacggccggatcgccagcgggcccggatgtccgaggcgctgacgtcaagccgggtgatgggcacaaaacgggcggcgtggccgccgggcaacgtccagacggccggatcggccgtgggcgtggcccccatgccctgggcatgggtggtcaaaaatgccgtgaaagcctcgatcccctgcccttcccgggaatggacggccagatcggccagtcggcccagccccaggccgtctttccaggaaggcagacagagcaggtcgctcaggccgaggatgaagcagaagtcctgccccgggcgcgaagcggccaactcggccaaggtgtcgcgggtgtaggacggcccagggcggtcagcttccaggagattgacggaaaaccccgggatgccggccacggcggcccggcacagggcggcgcgcagctcgaaatccagcagtttgccgccgattttgtggggcggccgagccgaaggaataaattccacggcggacagccccaaggcctcggccacctcgatggcggcccggacatgggcgacgtggacgggattgaacgtcccgccgaaaatgccgatcctggtcccggacatgccgcttcgctaaccccgcacctgcccctggccgagcaccacgaacttggcgctggtcagttccaccagccccatggggccgtaggaatggagcttggaggtggagatgccgatctccgcgccaaggccgagttcgccgccgtcgttgaaccgcgtggagcagttgacgccgaccatggaggcgtcggcccggcgcaggaaatccatggcccggtcatggttctcggtgcagatgacctcggtgtgcccggaaccgtggcggtggatgtgggtgagcgcttcgtccagggaatcgacaaccttgacggccaagataaggtcatggaactcgtggccgaaatcctcgggcatagccgccacggctccttcgcccaaaagcggcagggagcgcgggcaggcccgcatggtcacgccgacccggcgcaaggcgtcgccgatgcggggcaggaaggtcggtgcggcgtcgacgtggacgagcaggcactccagggcgttgcacacccccggacgctgggccttggcgttgactacgatggtctcggcccgggcctcgtcggccccgctgtcgatgtaggcgtggcacacgcccttgtagtgtttgagcaccggcatggtggcctgggagaccacggcccggatgagcccttccccgccgcgcgggatcatgacatcgatgagttcgtcgagcttgcatagggcggctacggcggcccggtcggctgtggggacgagctgggcggcgtcggccggcaggcccgacgcttccaaggcttcgcgcaatagcccggccagggccaggttggaggccagggcctcggaaccgcccttcaagatgacggcgttgccggccttgaggcacaagatggcggcgtcgatggtgacgttgggccgggattcgtagatcatgcagataacgcccaagggcacgcgcatgcacccgacgagcaggccgtttggccgggggcgcatggactcgatggcccccacggggtcgggcaaggcgatgatctcacggcaggccttggccatgccgtccatgaccgccggggtcagcgtcagacggtccaggcgcggggcatccatgccggccgcgcgcgccttttcgaggtcagcggcgttggcggccagcacgccttcacggcgggtttccagcagcccggcgagtccggccaaaaaggcgtccttggccgcgccggaagcggcggccatggcccgggacgcttccttggcctttcgggccatgacttccatgtcggcggcaacgctcatatgaacctccaggatagggcgcgaaaagttggctgatagccccttggccccggaaagtcaaagcgcctttgccgccagcgacacgccggccacgatgttgccgctgcgggttgcaacctgcgcaaagacggcctggaccacgccgaagcctgcttgcgacaagagcccctcaagctcttcaaacgtgaaatggtgggcctgatacagcacgaccccgccctcgcgcaccagaaagcttccggcctcgccggtttcggccagaccggcctcgtagcgggcccgataatacggcagatcgggattgcgcaggaaatcgcccagacacagtaggcccttgaccacccgccgggcttcggccaacacggccagccgggcggccggactcggcagcgtggtcatgaccgcctgaagcacggctacctcaaaggaagcgtcagcaaagggcaaggcggcaagatccgcccggaccacagccaacccaagccctgcggccagggccagactcggcggattgcagtcggccccgacatgggacgctccaaggccgtctcggcgaagcccggccagggtccgtcccgggccgcaacccaggtccacgatacggtctccggggccaatgagcgcccgcacttccgggacaagctccagcgaagacggcacggcggcggcattttcccaatatatggacatcattataattaagtcgccctttctggctccgcgcttttccggtcgcctcactccgcgtgcgtcataccaaatattggttgcgcaggtcatgtcgggcttgcgcaccacgaaccacgtgtatgggcggcaacagctttccgcccatgctcaggcaaaccgtggcgcgacagcacgtcaacgcgcagagtgtgtttcagttttttaaaaaaccaaacacctttcgccaggattggtttcgccagaaccaggtaaatcttatatcattcttaatttattatcaatattagcatgaaacacgttggcatgacaattgataatcattccgcgtcaatcaatccgccctacagggagaaggctatggatgctttgctgaaaaaactcttgctcgtacttgccgccgtcagcctgagcctggctgccacggccggcggggtcatggcccagaacttctcggccggaagcttcaacttcgaaccccggttcagcgcctacgggaccaccaatcctcgggtcaacaccatcatgacctacggcggcgcgctcaattattatgtcttcgacaacttcgccgtggaagctgaaggcatgggcgtttacatggaccagaccaaacgttttgagaccgcccttggctacggcagcaagtccgatcctgccaacggcatcggcgccaacttcaacgtccgctggcacttcgtggccaccacccaagcctcggtcttcgccggcgcgggtttcggcggcatgtgggccgacgccaagaccccgtacaacggttttgaaaacaacctgaccgagaacggcgagatcggcgcgacctattccctgacccagcagctgagcctcaaaggatcggtcaagtacctccacatcggccagttcaacaaccagggcatcaacgccttcggcggcaccctgggccttaatgtcagcttctagccagacccgggcgttcgccacgcccgtttgaccggggacgcccccggaggaaggatccggccgccccaacatgggcggccggttttcgtttgcaggcctcccttttcatttcgcgccgatagccctatagtggtccgataaacggccgaaaggtgcgggcatgagcaaaattctcgatcaggacgaagtcgatgcgctgcttcgggggttatccggcggcgagatcgaagcggaaaacgacattctggaggacgactccggggtcgtggtcttcgacctgtccaaccaggaccgcatcatccgcggccggatgccggttctggaaatcatcaacgaccgcttcgcccgcctggcctccaacgccatggccaacgccatgcgcaagcgcgccgacgtcaaccccatttccatcgacatgtccaagttcggggacttcatgcgctccctgcccgtccccacctccatcaacatcttcaagctcgatccgctgcgcggcaacgccatcctcgttgtcgactccaggctggtattcgccatggtggagagctttttcggcggggccggctcccagcccaagatcgagggccgggatttcacccctatcgagcaggccatcatcaaccgagtggtgcgcatcgccctggaaaacatggaggaatcctggcagcccgttcacgaggtccacatcgaactcgtgcgcagcgaggtcaatccccagttcgcggccatcgtgccgccaagcgatgtcgtggtcgtcgtgaccttcgaggtcgaactcgaaaacgccatcggctcgctcatcgtctgcctgccctacgccaccatcgagcccatccgctccaagctctacgcctcgttccagaccgaacgcctggaagtggaccatgcctggatcgcccggttcaaggaacggctcatggaaacgcccgtggaactcctcgtgcgctttggccgctcccagatcaccggccgccagttgttgtcgctcaagcccggggacatcctcatgctcgaaaacgacgtggacgaactgctggaagccgagatccagggcgttcgcaagttccagggcatcccgggcctggtcaagtccaacaaggccttccagatcgtcaaggaagaagagattcgtctcgaatagcttggctacacttttttgtgtatcgacaactacttccaatagttcattttttcacaaacattgcaaatgcgtcatggtcacacccttgcgaccgtgatagtttcccgtctcgtggaaccgcaaaccctggctctgtccatcctgccccagcccgatgacgccacctgcgggccgacctgcctgcacgccgtctacggctactacggcgaccacctccctctggaggacgtcatcgccgaggctcccaccctgcccgacggcgggacgcttggggcctatctcggctgccatgccctgcggcggggctacaaggccaagctctacaccttcgatctctcggtctttgacgtcacctggttcgcccaggacgtcgatctggccgccaagctgaccgaacagttggtcgtcaagaccggccgccgtctgcatcaggcctcggccgcctatctggaattcctgcgcctgggcggccagattcgttttgaagacctgaccgctccgcttattcgcgacatcttgaagcgcggccggcccatcctggccggcttgtccgccacctatctctaccgcaccccgcgcgagcgcgacgtggccggcaagaccgtgttcgacgatctgcgcggcaagccgtccgggcatttcgtggtgataaacggctacgattcctcggcccgcgtcacccatatcgccgatccgctcctgcccaatcccatcagccgcagccaatactacgaggtgacgctcaatcatctggtctgcgccgtcatgcttggcgtcatcaccgacgacgccaatctgctcgtgctttcgcctcgaaagaaaagccggtccgaggaccggcaaaggagtctctagtgtctgttttggtgatcatggaaaaccccgaggactgttccctggtgttttccggcgtcgaacccgtcgccgcccgcagctatctggccgacgaggccttcaccgccctgcgcggggtcaagatcatcaacctctgccgttccttccgctaccaatccatgggctattacgtgtcgcttctggccgaagcccggggccacaagcccatcccgtccatcacggccatccaggacatgaagtccgtgggcatcatccggctggcctcggaagaactggccgaactcctggaacgggccctggccgacaggccgcaggaaaaaataagcttctcggcctatttcggcaaaacgccggaaaaaggcctggaacagctcgcctcgcggctgttcaagctctttcccacgccgtttctgcgggccgactgcaactggcaaaacggctggcagctccaaaacgtctcgcctctgcctctgcgcgacatccccgaggaagagcgcgactttgccgaggccgtgtccaccgactacttcaccggcaaaaagctcaccatccccaagcgccaagtgagccgctacgatctggccatcctccacgaccccgaggaggaacgcccgccttccgacgcccgggccatcaagcgcttcgtcaaggccgccgagaaccttggccttggcgtggagatcatcacccgcgaggattccaaccgcctgtcggagttcgacgcgctgttcatccgcgaaaccaccaacgtcgatcaccacacctaccgcatggcccgcaaggcggcggccgaagggctggtggtcatcgacgacccggaatccatcctgcgttgctccaacaaggtctatctggccgaggtgctgtcgcgcctgaaaattccggccccccgcacggttatcgcccattgcaagaatatcgaccatatcctggaagagctgcccctgccctgcgtgctcaagcagcccgacagcgccttttcccagggcgtggtgctggtgcgcgaatccgacgcgctcatgcaggaggccaagcggcttttgtccaagtccgatctggtcatcgcccaggagtatctgccctcggaatacgactggcgcatcggggtgctggacaagcggccgctttttgcctgcaagtactacatggcctcgggccattggcagatcctgcgcaagggcaagtccggcaaggacgtctacggccgggtggaaaccctgcccgtggccaaggcccccaagaaggtggtcaacacggcgctcaaggcggcggcggccatcggcgacgggctttacggcgtggatctcaagcaggtgggcgacaaggtctacgtcatcgaggtcaacgacaaccccaacatcgacgccggcttcgaggacgaggtgctgcaggacgaactctatttgcgcgtggtggaagtctttctcaaacgcatcgaacgccgcaaaaccgggagcctcaacgtatgagcaaagccagacatctcttctccgctttcggcattgagatcgaatatatgatcgttgaccgcgaaaccttggcggtccggcccatcgccgacaagctgctggccgccgccggcggcgttccggacgccagcgacgtcgaactggggccggttacctggtccaacgaactggtggcccatgtgctggagatgaaggttagcaagcccgccaagaccttgaagggtctggccgccgcctttgccgccagcgtggccaaagccgaggaactgctggctccccacggcgcgcgcctgctccccaccggcgcccatcccctcatggaccccttcacggaaaccgtgctgtggccccacgagagcagcgaaatctacaaggcgttcgacgccatcttcaattgcaagggacatggctgggccaatctgcaaagcatgcacatcaacctgccttttgccggcgacgacgagttcggccggctccatgccgccattcgcgtgctcatgcccatcatgccggccctggccgcctccacgcccatcctcgacggcaaggccacgccttggctcgatgcacggatgcgccactacgcccacaacgccgaccgggtgccggcagttatgggcgcggtgatcccggaagccgttttttccatcgacgaataccacgcgcgcattctggagccgctctaccgcgacatcgcccccctggaccccaagggggtgcttcgcggcgatttcctcaacgcccgtggggccatcccgcgtttcgagcgctccaccatcgaaatccgggtgctggacacccaggaatgcccggccgccgactttgccctggccgacgtcgtggtctcggccctcaaggggctggtggaggaacgctggtccacctatgaggagcaaaaagcctgggccacaagcgagctggccacgatatttaacgccaccatcgaaaacgccggccgggccaaggtgcccgacgaatacgcgcgccttttcggcgtctacgccccgtcctggattccggcccgggtcatctggcggcggctggccatgagttcgttgccgaccatggacttcgatcccgactgggaaaaagctctggccgtgctggtcgaccagtcgagcctggcccggcgcatcctggccgccgtggacggcgactgccggccaacgaacattcggcgcgtctacggccaactggccgactgcctggagaaaaacgagcccttcaatgtcggcatcctgggcgctccttattacctgtgagcacggcggggccgacatccccgccgcctatgccccgctgtttgacggctggcgcgacgccctggccagccaccgggggcacgacttcggcgcgctgtcaacggcccggaggctcgcccgggccgttgacagcgcgccgctgctcttttccacaaccagccggatgctcgtggacctaaaccgttcgcttgggcatcccgggcttttttccgaggcaaccaagggcctgccgcgccgggacaaggacgccatcctcgcccgatactaccaccctcaccgcgacgccgtggccgccgtggtcgccgaggggattgcggctgaccgcacggtgctgcacatcgccagccacagcttcaccccgcgccttcgcggcgtcacccgccactgcgatgtgggctttctctacgaccccgggcgcagcgccgaaaaggatttttgccgcaactggctgcgcgagctggcctgcctggacggcgacctgatcctgcggcgcaactacccctacaaaggcgtgtccgacgggatggtcacagcctttcgccgccgtttcggcgagcgctatctgggcgtggagctggaagtgaaccagcgcttcgccctgggtggagacgaagcactggggagtatcagcgagacgttggccgatgcgctgcagcgggcgcttgggcgcacggcatcctgacgccgctgacggcaaatcgtgcaaaagcgccggaaccgaacacatcggtagagaggtcgccgcctcgatcactaccgacagcccatcagggccacgccttcaatctcgcgccaccgctgccgcaaaagcgtccgtgaccgcgcctcccgcgccctcccgctcccgtggcttccttgcctccgaagcctttttcgtggcactagaggcttccaccagccacccaacgcgcccagggagccttgaccgcccatgcccgcccctttttccgtgcccgatatcctgggctcccttgagcggccggtcttggccgtggacgccgacggccgggtggccaacgccaaccccgccgcgctttccatgttcggccccgaggtggccacgcccggcgcggctctgcctctggcccggcccgacctgtggcagcccatggccaaatgcctggccgagggcgacgtggtctatgatcgcctcaatgttggctccaagaccgtggtcgccaccacctttcccatctgccgcgacggccgggtggtcggggccacctgcatctgccgcccctgcgccggcgaagcccatccggccatggaaggccgcttgggggccatacttgattccgtgtccgacggcatctggatctgcgacggcacgggaaccatcctttcgatcaacgccgcttccgagcggctcaattccgtcaacgccgaggactacgtcgggaaaaatgtctccttgatcgtggcccagcgcatggtcgaccgctcggccaccctggacgtgctcgaaaccaaacgccagtcgagcatgatccagcacatcaccaagaccggcaaacagctcttggtcacggccacaccggtccttggcgaccagggcgaggtggccctggtggtggtcaacgagcgcgatgtgacggaattgcaaaatctgcggcaggggcttcaaaacgcccgcaaggtcgaggagcgctaccgcagcgaactggccgagttgtcgcttttcgagctttcccagaaggatatcgtggcccaaagcgggcaaatgcagcgtaccttgcgcacgctgttaaagctcgcccagatggacgcctcgcgggttttgcttcttggcgaatccggcaccggcaagggtctgctcgccaaattcctgcaccaggtcagcccccgttcgcccaagccgtttattcagatcaactgtccggccgtgccggaaaacctgttcgaggccgaactttttggctatgaaaaaggggcctttaccggcgcgcgcgaggccggcaaggcggggttgatcgaattggccgccgggggcacgctctttctcgacgaggtgggcgacatccccttgggcatccaggccaagctgctcaaatacctcgacgaccacgaactgcgccgcctgggcggggccgaggcccgcaccgtggaatgccgggtggtggcggccaccaactgcgacctggaaggcctggtcgagcgccgccagttccgcaccgacctctattatcgcctcaacaccttcgtggtgcgcatcgcccccctgcgcgagcgtcgcgaagacatcttcggcctggccgaattctacctggcccagcaaaacgcccgccatggcaaggccaaacgcctctcggcccgggccatgcgccagctcgaagcctacgcctttcccggcaacgtccgggaactcgtcagcatcatccagaaagcctttgtcatgagcgacgacgacgacctcaccgacgcgctcattgaggccctggccggcgacgcgccgccagcggtggacacgccgtccggcccccgtcccctggccgattccaccgagcaaacggccatccggcgtctgcgcgaggccatggccgcctgccgcaccacccgggagatggccgcccaccttggggtgagccaggccacggtggtgcgcaagctcaagcgttacggcctttcccgctcctgattcacttctgcatcagccgtttgcggccaggaccgggataaacgttttttcgttttatccggtttggcggcttattgcctatcatttgggattctcacgtgattgacgctttctgacggaaagggccgaggaacacgcttggcgtttccggccgtgtccgtggcggaaaatgctgattcagcttgattcagcatcttgtctcacagcattattttggatttattgatttttaacatttttgctgattcacaatagaatcacagtctcgtagccaaattcgtcatatgacttataatacattgatatattttaacatacaaactcggtccgcttcttgctgagaaggcagcttgccaactgtgtgcattttagtacgaggcacttacgccaccacctgaaacatccgaggatgatccgtgaacaccaccgacaaggcgcaggaactgcaagcattgcgtgatcgctatgtccccaaggggcatcccaacgccacgccctttttcgtcgaatccgccaagggcgccctgcttcgcgacgtcaccggacgcgagttcatcgatttcgtcggcggcatcggcgtgttaaacgtcggccactgccaccccaaggtcgtcgccgccgtcaaggatcaggccggacgctatctccacacctgctccatggtcaccatgtacgagccctacgtccagctcgccgcccgcctgtccgaggccgccccgggcgacttcgagaaaaaggcgatgttcgtcaacagcggctccgaagccgtggaaaacgccgtgaagatcgctcgttgccacaccggccgggccggcgtcgtgtccatgaaaaacgccttccacggccgcaccctgctggccatgtccctaaccagcaaggtcaagccctacaaattcggcttcggccccctggccccggaagtctaccagtaccccaactacgcctactgctaccgttgccccctgggcctgacctatcccaagtgcggcgtggcctgcgccgacaagctgcgcgaattcttcatcgccaccgccgccgccgagaacatcgcctgcatcatcgccgagccggtccagggcgaaggcggcttcgtggttccgcccaaggaattcttcgagaagctgcgcgccatctgcgacgaatacggcatcgtctttatcgccgacgaaatccagtccggctttggccgcacctccaagctctttgccatggagcacttcggcgtggccccggacctcatgaccgtggccaaatccatgggcggcggcctgcccctggccggcgtggtcggcaaggccgagatcatggatgccgtggccccgggcggcatcggcggcacctacggcggcaacccgctggcctgccgcgccggcctggccgtcatggacatcttcgaacaagacaacctgctggccaaggccgagcgcctgggcaacgtggtcaagcgccggtttgccgcgtttaaaaaacagtaccagctcatcggcgacgagcgcggccttggagccatgcgcgccctggaattcgtctccgaccgcgccaccaaggccccctgccccgaggcggccaagggcgtggccaagttctgccaggacaacggcctgctcgtgttgtcctgcggcaacttcggcaactgcatccgggtgctcatgccgctggtcatcacccgtgaccagctcgaccgcggcctggacattatggaagaaggcatccgcgaggtctccaaaagcctcggcaaataacggcaacaaggcccgacccagccaaccgacaacgtaaagaggtgcaggcatgaaaaacggttccatcacgacgattctggccggctgcatgggcatggccctgtccgccgccctgttcgccgctccggccctggccgccgacaagaccgtcaagatcggcaacgtcgagcccctgtccggtccgtcggcctcggtcggcgtccagggcaagcaggcccgggaaatggccatcgaggagatcaacgccgccggcggcatcaagtccctgggcggcgccaagctggagctggtctacgccgacagcaagtccgaccccaccgtcggcgtcaccgagaccgagcgccttatcaacaccgaaaaagtcaacctcatgaccggctgctggaactccgccgtcacctacccggccacccaggtggccgagcgctacggcatccccttcgtggtgcccgtggccgtgcgcgacaccatcaccgagcgcggatttaaaaacgtcttccgcatcgctgccaaggactcctggtgggtgcgcgaccagttccgtttcctcaaagatatgcaggaagaaaccggcgtgaagctgcaaaagatcgcctttgtctttgaaaacggcgactggggcaccggctttgccgagaagtggcgcgaactggccaagaaagacggctacgaggtcgtcctcgacgaaccctatcccagcaccgccaccgacctcaccccggtggtgaccaagctcaaggccgccaagcctgacatcgtcatgctggtgtccaacgccgccgacgccatccttttgaccaacaccatggccgaaatgcaggtcaagcccaaggtcgtcctggccagcggcggcggccacgccgatcccaagttcctggaaaacaccgacaccaacgccctgggcatctttgacgaagtcgagtggaacaccgacgtcaacaagcccgccgccaagccggccaacgagaagttcaagaagaagtacggctacgacctgaccggcgagtccgttgacgcctacgtcgccatgtatgtcatcgccgacgccctggaacgcgccgcctccaccgagccggccaagatccgcgacgccctggccgccaccaacctgaccaccggaccgggcatggtcgtctcctacgacggcgtccagttcgacgagaccggccagaacaagaacgccggcatcgtcatcgtccaggtggccaacgtggacggcaagcccgaccgcgtcaccgtgtggcccaaggccgcccgccgcgccgggtacgtcccggccttcccggccaacaagtagtaacacgttgcagtaacgccccggaccggcctttccggtccggggcaaacgtccggagaggcttttcatgaccgcggtgattcaggcggcgctcaacggcgccatgatgggagccatgtacgggctgaccgccctcggattgaccctgatcttcggggtcatgaaggtggtcaacttcgcccacggctcactgctcatggttggcatgttcagcgcatattggctgattcgactcacgggcatccacccgtatctggcccttgtcatcgtaccgcccgtcctgttcgttttcggctattatctgcaggacgtggtcatcaaacccgtgttcaaagccgaaggccaggtgcgcgaaccgttgacggtcatcatcgtcaccaccggcgtctggtacgtccttgacaacctggcgctcatgctgtttggcgccgagtaccgcaccgtgcgcacggccatttccaacaagtccttcgcgcttggcgaattcatcatctccatccccaaattttccggcttcgtggtggccgtcgccacggccgtcggccttgccctttttatgcgcaaaaccaaaaccggcaaagcccttcgcgccaccagcctggaccgcgaagcggccaacctcatgggcatcaaccagtaccgcatctacaacatcgccttcggcctcggcacggccatcgccggcatcgcgggctgcgtgctcatccccttttactacgtctacccttcggttggcgtggtcttcgacatccgggcgtttatcatcgtcgtgcttggcggcctgggcagcattcccggtgcgctccttggcggcttggtcatcggcctgatcgagtccgtcttctcccagttcatggcctccacctggaccgaagccatcatctacgccatcttcctcatcattctcttcgtcaaaccatccggcttcttcggccacaaacaggattggtaggaggcgcgccgtgagccgaaaacaactcgaccggatattgctggcagtggttgccctggccgccttcgggctgcccctggtggtgacctcgcccacctatctgcaaatcctcatcctgctctttttctacgcctatctgaccacggcctggaacctggtcggtggtttcgccggcgtgttgcccttggggcattccgttttcgtcggcatcggggcctacacctcctcgatcctgaccctgcagtatggcgtgtcgccctggatcggcatgctggtcggcggagccatcgccgccgtcatcggcgtcatcatcggcctgcccaccttccggatgcgcggggcctacttctgtctgtgcaccatcgcctttgccgaaggcatccgggtcatggtggaaaacatcgacaccttgggaccgctcaaaataaacggcccccggggcctgctcgtgccgctgctcaaggacccgacgttctgggactaccagttcatgtccaagctgccgtactattacatcatcttggtgcttctgatcctggtcctggcctttacctggttcgtctcacgctccaagatcggctactatctggccgccggcggcgaagaacccgacgccgccgccgctctgggcatcaacgtggccaactacaagctcttcgccatggccctgtcctgcttcctgaccgccctggccggcacgttctacgcccagctcatgctctacttctatcccaagggcctcatgggcctggatctctccttcgagatcgcgtttatcgcgctcatcggcggccggggtaccatcgccggcccggtcatcggcgcgctgctcttgcgaccgcttaatgaattcacccgcatctacttaagcgacatgctgcccgggctgcatctggtcatcttcgggctcatcctcatcctggtcatgatctacctgcccaagggtctcaccgcgccactggccgccctttatgaccggctggcccgcaaaatcaccggccagggagcagcgaaatgagcaacatcctggaagtcaccaatctcaccaagcacttcgggggcttaaccgccgtcagctccctggacctgcacatcaagaccggcgaaatcctggcgctcattggtcccaatggcgcgggcaaatccacggtctttaacctcgtggccggcgtgttcgccccctccgaaggcgtgatcaagttcgccggacagaccatccacggccaaaagccctgggatctcgcccggctgggcctggcccgcaccttccagatcgtcaagcctttcggcagcaagaccgtgctgtacaacgtcatggtgggagcctttttgcgcaccaattccaccatcaaggcccgggaaattgctgaagaagtgctggtcaccctccagctcgaccataccaaggacatgctggccgccaacctcaccatcgccgaccgcaaacgcctggagatcgccaaggccctggccaccgatcccaaactgctgctcctcgacgaggtcatggccggactgcggcccaccgaagtcgacgacatgatcggcatcatccggggacttcgcgaccgtggcgtcaccgtctttgtcatcgagcacatcatgcgcgccgtcatggccctgtccgaccgggtggtggtcatccagttcggccagaagatcgccgaaggctcgcccgaggccgtcaccaaggatgaaaacgtcatcaaggcctatctgggaggcgagtatgacgctgcttagcgtggagaacatcaacgtcgcgtatggcgacgtgcagatcatcaacgacctctcgctgacggtcaacgaaggcgaggtggtgagcatcatcggcggcaacggcgcgggcaagtcgaccttgctgaaggccatttcgggcctggtgccgccaagttcgggcatcatccggtttcggggcgaagccatccaggccctgccccccgaagccatcgtcgagcgtggcgtcattcatgtgcccgaaggccgccggctcttctcgctcatgaccgtggccgagaacctggacatcggggcctacaactcccgggcctataaggaccgcgacaaaaccctgcgccaggtctacgaactgctgccgcgcctgctcgagcgccagacccagctggccatgacgctctccggcggcgagcagcagatggtggccatcggccgggggctcatggccctgccgggcctgctcatgctcgacgagccgtccctgggtctggctcccatcctggtcaagtcgatcttcgagaccctgcgcaagatcgccgacgccggcaccacggtgcttctggtcgaacaggacgtcaaccattcgctgcgtctgtccgaccggggctacgtcctggaacacggccgggtggccatgtccggctcggccaaggaactgctggaaaacccccacgtcaaatcggcctatctcggcatttaaaaggaaaagccatgcacggctttcacggacgcatcctcactgttgacctgacccggcgcgcgtttgccatcgaagcggccgacccggcccatcttgacgcctatctcggcggcaagggcctggccaccaggctgctccttgaccgcaacccggcaggggtcgatcccctggccccggagaacaacctcatcttcgccgccggccccttgtgcggcggcgtggcctggggggccagccgctacggcgtgttcaccaaatccccccagaccgggttttacaccgaatcctattccggcggccgcacgccccaggccgtggacgccgccggtttcgacgccgtggtcctcaccggcgcggcgaatgcgctcacggccctgaccatccaccccgacggctgcaccttccacgacgcggccgatctggccggccttgacgcctacgccaccgaagacgcggcccgggagcgtttcgtgctgccccgcgacgacgccaagcgcgtgggcgcggtggtcatcggcccggccggggagaacttgtgccggctggccatgatcgccaacgaacgctggcgctgcgccggccgcaccggcgtcggcgcggtcatgggctccaaaaaggtcaaggccatcgtgttccagggcgaccgcaagcgccaggcggccgatcccgccggcctggccgcccatgccgccgcctttgccaagcgcggggtggagaccaagggcgtgcaggtctacaaggccatgggcacgaccatgatggtcggggtcatgaacgcggccggagcctttccggccaagtactggacccagggcaactgcgaacattgggagaagatctcaggcgagaccttccacaaggagcacgaggtcaaggcccacgcctgcgccaaatgcttcatgtcctgcggccgcatggccaagctcgcctcgggccgccacaagggcctgaccctggaagggccggagtacgaaaccatctacgccttcggcgggctgtgcatgatcgatgacatggccgagatcgtgtatttaaacgacctctgcgaccgcctgggcattgataccatctccgccggcaacctctgcgccttcaccgtcgaggccgtctcgcgcggccgggtggactaccccatcgcctacaacgaccccgacggcgcggcccggctcatccaggacatcgcctcgggcacgggcatcggggcgctcctgggccagggcatcaaggtcgcggcccgggcctggggactggaagacctggccgtccacgtcaagggcctggagccggccggctacgacccccgggcgcttcgcggcatggggctggcctacgccacatccgaccggggggcctgccatctgcgcaccaccttctacaagcccgagctggccggcatgatcccgcccgacgccgtggaaggcaaggcggccatgctcatcgagttcgaggaccggctcaccatcttcgatacgcttatcctgtgccggttcttccgcgatctctacacctgggacgagctgacccaggtcatcggcctgaccaccggcctcgacgccagcgaagcagcgctcaaacgccgggccgcggccatcgccgacatgacccgggagttcaacctgcgcgaagggctgaccccggccgacgaccgcctcccggagcgcatccaccgcgaacccctgccaagcggcaaggaactcccccgcgaggccttcgacgccatgctggccgactattaccggttgcgcaattggtcgcctcagggcgtgccgaccggcgctgccgacctctaaccccaaagcatcccaaaggagcggtacatgcttgtcggcgattggatgtccaccgacgtggccacggcgaccgaggatgtctcgatgatcaaggccggccggatcatgcgcgacaaaaaaatccgtcgtctgcccgtggtggacaaggacggaaagcttgtcggcatcatttccgagcgcgacctcaaggcggcctcgccgtccacggccacctcactggacatgtacgaaatgacctacctgctctcggagctcaaggtcaaagccatcatgaccaaggacccggtgcgcatccgccgcaccgacaccgtggagcgggcggcgcttatcatgcgcgaccgcaagttcggcagcctgccggtggtcgatgaaacgaacaaggtggtcggcatcatcaccgacaccgatatcttccgcctgttcgtctccatcaccggcatcgaccagggcggcatccagatcgggctgcgcctgggcgtggccgagggcagcctcaagccggtgctcgacgaactgcgccgcttcgaggcccgcatcgtgagcatcctgtcgtcctacgaccggggcggcccgggccagcgcgacgtgtccatccgcatccaaggtctgcccgagacccgggagcgggaactgcgcgccgaactcgaaaagaccggccacctgctctactggacccgcgactaaccgaaagttcctgtcctcgcctcgccccggacggccccatccccgcatggccgtccggggctcttttccctgcaaccgccctgtcgccgcctcttgacgcccgacgtccgcttctggttttctcatttgaacatgccgtccccaaccgtgttgtcctgcaagcccgtgatcaaactcaacagcgcccggcaaaagacctgggaagcgcttttttgcgtgcccgcccggccggacatcctctgggacgacgtggccgcgctgatccgagccctgggcggccgtgaaatccaccatcaccaaaaaaccgccggctcgcgggtgcggtttgtccttggcggcgtcaagggcttcttccaccgcccccaccccgaaaacgtgctggacaagggctgcgccgccgacgtgcgcgaatacctcctgcgcgccggcatggccgtctgaccgcgaggctctccatggacaacgccacctgctacgccgtctacaagggctattgcctcgtctgctccgcggaggaagacggcacgctccacggccgcatcgacggcatccgcgacatcgtcaccttccacgccgccacccccgaagcactccagatcgccttcgaggaagccgtggaggactatttggccgtctgccaggaatcctgcctgccgcccgacgtgccagcctgagccgagctcctggcgttagtctgcctgctgccacggccggcatgaatcgcgccctgactcgcccgccgctctttcgctcttctggcgcacggcctgggcagagccccgtcgacgcgggacccccgcttgttgccgccgagtataagctgaccggataggacggttgaagccctttccctcccactttcatcaattgacatcaattctcaatttcattatcagcacttcatcccggggcgtttccggacggtggccatgcccggcgcgtcaggcggcctggaagtccgcgccatgccgcctgacgcgctcctgctccgatgacggcgacgccccgggatatttcttctggaggttgccgttgatcccgtctcacgtcgcccgcgccctgaccaccctgctccccatccgccaacccgtatttctctggggtcccccgggcgtcggcaaaagccagatcgtggctcagaccgccgccgctctcggccttgagctcatcgacatccgggccgtgctccttgatcccgtggacctgcgcggcttgccgcaaatcgacgccaacggccgcacccactggcgcgctccggcctttttgccgacaagcggccagggcgtcctttttctcgacgaattaaacgccgccccgcccctggtccaggccgcctgctaccagctcatcctcgaccgggccctgggcgaataccgcctgcccgacggctggaccgtcatcgccgccggcaaccgcgatcaggaccgggccgtcacccaccggatgccgaccgctttggccaaccggttcgtgcacctggaaatcgaaccccacctggaggactggattgcctgggcggaagctgcgggcatcgcgtccgaggtcacggcctttttgcgcttccggcccgctttgctccacgatttcgatccgacccgggccgtccggtccttccccacgccccggtcctgggaattcgtgtccaccatgttgcagggcgcgcccgatccgcaggtggaactggaactgctgcgcggggccgtgggcgacggcgcggctttggaattttccggatttttgcgcacctggcgcgagctgcccgacaccgacgccgtgttggccgatcccgacgccgcgccggccccggtggaaccggccgcagcctacgccatctgcgaggccctaggacggctggcctgcccggacgtcatgccggcgctgacccgctacgccgcccggctgccggtggaattcggggtgctgctcatgcgcgacgccgtgcgccgcgacagccgcacggccaagacgccgtcatttgccgcctgggcccgggacaacgccgaggtgttcgtgtgaccgcgcccgacgccgtgggccgaaagctcgtgcgggcgcgcatggagctcgtgctgggccacccctttttcggggccatggccctgcgtctggcccccctggccgacgcctcctgccgcgacgtctggaccgacggcgtcacgctcggctacaatcctctttacgtgaccgagcgcagcgaggacgaaatcgcggcgattatcgcccatgaaatcctgcacttggcctgcgaacaccatctgcgccgcaaggaccgggacaaggcgctgtggaaccgggcctgcgacctggccgtggccgcccttttggtggaagcgggtttcaccctgcccccgggccaccccttcgaggccacccaggccggcaaaccggccgaggccatctatgccgtgctggccggcgaaatcgaccagcgccacggcggcggcggcacggatgcggccaagacatcggccctgccggccgacaccgccccgggcggcggcgatggcgacacgccgctggccgccaaggccggacaagccgaacccgcgccgtccggctccgcgcttaacggccaggacaagcagccccaaagcgcctcgggcgaccaggacagggccggaacccttggccaaacgccaagccgcagcatcggcgaggtgcgcgaccacccggacctggacgggcagcgccgtgaatccgaacaccgcgatctgaccgacaagctgcgccaggacgtcaaccagtcgcgccgggcggccagcgccatgggcaacatgccggccggcctcgaccggctgctggccgagctggccgcgcccaggctcgactgggcggcgctcttgcgccgcttcatcctggcccgggcggtcagcgactattcctggtcgccgcccagccgccgccatatccacctgggcctctatctaccctcgccgcgctccatgaccctgggcgaggtggcccttgttctcgacacctccggctcggtggacgaggagcttctcgccgccttttgcgccgaactcggctccatcctgagcgcctgcgaggcaagccttcacgtctatgcctgcgacgcggacgtgagcgaagcgaccgtgtactcccgggccgatccgcccctggcgctgactccgcgaggaggcggcggcacggactaccgcccggccttcgccaaggtcgaggccgacggcttgcggccggcctgtctgctctatttcaccgatctccagtgcgaccgctttcccgaggagccggcctatccggtgctgtggatcgtgccaaaaaccgccaaggagcgaccgccgttcggcgacgtcgtgcaactggactaggagagtcccctatgcgcatcacctggcatatcgtcaaaaagcgcggcaacctgcgtcccgagctagtttacgacgtcgtcctggaaggccacgaaaaggctctggccttgccttacgtgcgtgtcgattcgaccatccccgagccgccgtcctcctggcaggcccactgctatcccggccagcacgaacgggccggggccgcgccggccggcttttaccagctggccacgcccaaccacgccaccggcacgctgcggcaaacgctgcgcctgccctggcggcaggacaacgcctacccggaagtggaagcgtcgtttgcagccctgcgccgggccttcgagatggctttggccgaggccggagccagccagcccatggacatgtggggagagttgacgctgaccgccggcctcaagcgggatctggccccgtcgctcatggccgaccggctgctggggttggcccagtagcttcacgcaggttcaaacgctaaggggccgcccaggaacccgtcccgggcggccccttggcgtttactccgggccggactcatggcgcgcccacgaaaaacgcctgatggaaatgtcaaatccaccgccagccgccacccaaactatcggttgcccctccaagatgtggagcaaaaaaggcatcttcctgtcgctttcttacgccacaacccagaccgccaaccccttggcagcgtggatgattttggtggagacgctgccgaagaggaattcctcctgcttggacacgccgcgccggcccacgaccacggtgccgtagccgccttcctcggccagccgcagcacttccagggcgatgctggtgccgatgctgcattcggtggcttcccgcagcggcgaacggcagctctccacgaaccgtgtgccgaccttgtcgtcggggatgccggccgcgacgagcatggcccgggcctggtccagggcgtcgcgcatggcggcgttgcggcgctggcattcggctttccaggccgcgtcatcggcaaaaaggtcccggtcggccggccgttcgatggcggccacatcgacttgtcgggttccgtcgtgcccgaccatggccgcgacataggccacggagcgctgggcattgtccgatccgtcgtaggcaatgaggattttgtcggtgttcatggctgctccaggtcagatgccgtttcggccaagggcttggcgggcgcggcagaggtcgtcgatgagttcgccggccgtgtcgtaatagacttcggcggccagggaaaaacgccgcaagacattggtcatttcgagcgggatgtagggaaagagcttttgcagattgacgatgcggttgggaaacatgatggagcaatcgtcgctggtgatttgcgcccgcaaggccggcgagatggactgggtggtgtgttgtcccatgccgaccaggaactggatgatgttgcccaggccaaagagatcaaggccaaacgggctttcctggaagtcgaaggtgtagtcgaaatcgatccagcagtactgcccggaatcgtggagcacgtagaggtggtcgcggcgcacgtcgccgtgtttttcgttgcggtcatggagccatttgatggcctggcaggcctcgatgaagcgttcgaggaccgtgggaaaaaggtcgtgaaaatagtcgcggtgcggcatttccagggcctcgatcttctcgtccaggcgcttgccggcgacgaggtcgaggatgcgcacgggattgtcggccgcgtcgtagatggtctcgccctgcatgaagcgtgggtcgccacgcacaaggtcgaggatgcgggtctccttgcgcgggcttctggtgcaggtgaccaccatggagccgatggtcatgggaaagttctcgtggaaaacgagcttgacgatgttgcggccgccggtttccaggcagcggcagcgtttgacccagtactttgggtcttccatgccgaagcggcgttcggcctcgtcgcgaagcaccaggaagtggcgctcgccaaggaccatgacgtcgccgtagccgatgcgcatgaattcggtggtgtcgtcgtagagttccccgacgtggcgggccgggaaatccggggccagacgggtgagcaattcgcgggcggatggggccaaggacgcctccgtgacggttggacgtttcccattccttgcccgatttcgggttgttgggcaacggagacgccggcatttgaaccgcttgtctgggacttggcgaggggctaggcttggtgcgcgtatgcccggcatcagccaggcaggatgacgacagggaagttggagggccttatgatggacaaacgtgtggccattgtcactggagcgtcccggggcatcggcgcggccgtggcccggcgtctggcggcggacgggctggcggtggtggtcaattacgtgactgggcaaaaccgggctgaggctgttgtgcgcgacattgtggccgagagcggccatggggtcgccatcggggccgacgtgtccgacccggccgacgcggcggcgctcttcgaggcggccgaagctgttttcggcggcgtcgacgtcgtcgtcaacaacgccggggtgatgcagccggggctggtttccctggccgacaccagcgacgacctgtacgagcgcatcgtgtccatcaaccttggcggcacgttcaacatgttgcgcctggccgcgacacggctgcgcgacaatgggcgcatcgtcaacttctcctccagcgtggtcggcctgcggccggccggctacgccgtctacgccgccaccaaggcggcggtggaaaccatgaccgccattttcgccaaggagatgggaccgcgcggcatagccgtcacggccgtggccccggggccggtgggcacggagctgtttttgacgggcaagacgccggaaatggtggagcgtatcgcggcggccacgccccttggccggctgggcacgcccgaggacgtggccggggtcgtgtcatttttggttggcggcgacggcggctggataaatggcgcggtcattcgggctaatggcggcatggtgtagcggggcgcattggtcggttttcctgaacaggatgtccaggcccggggccgccggactctgccggttccagggacagccccggggcagttttcggcgtgatcccgatggatgcttgccgggacggttttttcgacaaaaaagcgcaccggcgcggactatccgcgccggtgcgctgtatttcattgtggttcgcgcaccgctcaggcggcgtgatgggtggccgcctgttgcgtcaggctggccagcccggcgaggtcttcatcggaaaagacccgagccgtgtcgaggagtatgatgaaacggccgttgtggcgagcgatgccctggatgcaggccgcctcgacgtcggttcccatgcccggcggcggcgcgatggcctgggcgtcgagttccagcacttccttgaccgcttcggtcagcgcccccaccagtcggacgcccccgtcggggtcgggctgctccacgatgacgatacgcgtattcagggtttggttgactgggccgaagccgagcttgaggccgagatcaaggaccggcacggcctggccccgcacgtcgaccaccccgcgcatgtggtcgggcatccgcggcaatctggcgatgtccgtatagtcgaggatttcccgcaccacgtggatatcgatgccaaagatgcctgtttcgcccaggatcagggtgagaaatcgccggacgccgatattcgatgtctgattcatggccgtccccactctagaattgttcgaaatgctcgtcgccaagatcgaccttggccgccgccggcaacggcacaccttttcgggggagggccttgcgcggggtgcccttgtcgcccgtggccgtgcggtgggcggcccggggcacgccttggccggccacttggaagaagcccacggtgctgacgagctgggcggcctgggaggaaagttcctcagccgtagaggccagttcctcggaggccgaggcgttttgctgcacgacctgatcaagctgctgcaggcccttgttgacctgttccacaccggagctttgctcctgggaggcggcggcgatctcctgaacgagatcggaagtcttgaggatgtccgggacgagcatttccaggagtcggccggcccgttcggccacgtcgaggctggaggcggacaaggtgttgatctcagcggccgcgccctggctgcgttcggccagcttgcgcacttccgcggcgacgacggcgaatccccggccatggtcgccggcccgggcggcctcgacggcggcgtttaaggcgagcagatcagtctggcgggcaatttcctcaatgatggagatcttggccgcgatctggcgcatggcggccacggtgtcgaccatggccgcgccggattccttggcgtcggcgctggctttcttggccagggtttcggtctggcgggcgttgtcggcgttgcgcatgatggagctgttgatttcttccatggaagaggaactttcttccactgcggcggcctgttcggacgcgccttgggacagcgactcggaagaggcgctcagttcctcggccccggaagccatgttctcagcaccgcttttgacttcttcgacgatctcggtgaggcgttcgatcatggaagccagggagcgcatgaggacgtcctcggcgcaacgcggctccacctggatgcgcaggttgccctcggacatcatctcggcgatctgcgtgacgcgcgtttcggcttcggccacctcgcgcatggcctggcagacctggccgacctcgtcggcccggaccacttcgagtttgtggccgagatcacctcgggccagggccttggcaaactccatgcaggcaataagcggcttggcaatggcgcgagagataccgacgccgagcagcaggccaatgacgatgcttgtgccgatgatggcaaaaagcacgtttcggctcgtattgtagatttcgctggactcgtcgtagtatcttttggcgttgttttccttgatgcgaacaagatctgtcatgatatcgtcaacagcgttaaccttctcgcgtccgacccccaaggcaagatcaacggaagtcctattcgactgcagttcttctttattgcaagcctcaataatttgattccatacaggttgcagggcattccaggcggcatcgagtttggcaattttctctttgccttccttggagaagaacaagtttctggcgatgttcatctgctcctggtattcattcttatatttttccaggctttttacgttgcgagcgcgatcttcgagtgaagtcgtcatgatcatgtttcgcacggcacggtcagcataaataagatcgatattggcttctttgacagcagaaatgccaagaagctctcgttcgtacatcgtgttattcatgctattaatggcacccatattgtgcaaaccgaggtaaccgacaattcctgtaataatcgccatgataataaaagaaatgatcagtttcttgccaacgcgcaaatcgtaaaaccactgcatgaaacaactccatatcaaaacaaaacataaaaacatcagtccggcgtctatgccctgactgatcacccaaaaccgcttcccccaatcatcaacttcaacgccccgaacaagccccccgcctgcatcgggatacgcccttgccaccgacagtcctttttaaccaagggcatgcggcaacctgggttggcgactcgcgggcatggcaaatccagatcgtcattgctctgcgaatttcctggattttttgcatttctcgcaagtgtgccgcctttcgtaatttaaatggaccattaatattttgcaataagatttgttgttacgctaaccatatgttgtcaaatggtttattatgtgaataataaccgtttctccatggcacgcctaaggacggacaacgtacagcctccatccgatgatgacgccgaacatcgccatgcaggattggagaggcgagtcctgacccggggttcaagagacgagtgcaacgcccatcgattgcgaagcagtgacgaggcgcaatggaggcaaggggctcatgcaaagtggcgacgacgaatgacttgaggccttgtgaacaacaattctatgaccgtcagtccccgttcagtcgagaagcgtcaagtatggcggaatgatgttctggcggcaggcggtttgcccagcgttcggaaagggcatacctggtgcgccaagttcgtcgtgggcagtcgtggctggctggttgttctgcacaaaaaaaaggccttgcggcatctgccgcaaggcccttgcaatcctttggtggaggcgatgggacttgaacccactacctatgcgttgcgaacgcatcgctctcccagatgagctacgcccccgttgggagaaaggttattaagcgtattcgccggcccggtcaagaaatcctttgccgttttcgtggcgtcggccaaatgtcgccggccggcggttgacctcgggcgttcctgatgccactatgccaattgaaagatacccgaaaccattatgccttttttggcgatttcgcctctggagatccgaccatgaagatccatcgcgccctgcgcatggagcgctgcatcggctgccattcctgctccctggcctgcgcccggctggtgtacaagtccatgtcctggcagaccgccggcattcgcatccggtccaccggcggcgtgtccagcggcttccaggccatcttgtgtctggcctgcgacccggccccgtgcgcggccgcttgcccaaccggagccatgagtcagcgcaagtccggcggcggggtgacgctcaaaaaatccctgtgcatccagtgcggccagtgcgccgccgcctgcccggtggacgccatcaatcttgacgcggccggcaatcccgccgtgtgcctgcactgcggccagtgcaccgcctattgcccccatgactgcctggagctggtcgaggccgacacgcccgccgccccctgcctggagagctgccatgtcgaatgaggcaaacgatctgttccgcgtcctggtgtatgacctcgaacgcggtcgcggcgaattggccatcctgcccggtcggcggcaatgcctcggcggctcggggctggcggcgctcctttatgaaaaatacggcctgcccacggccccggccttcgatccccgtcagccgctgatattcgccattggtccggccacgggctatttcccgctcatgagcaagaccgtgtgcggcttcaaatcgccatataacgaaaactacgccgaatcccacgccggcggccgctcggccctggccctgcgctttgccggctacgacgccctggtcgtggtgggcaaggccccacggctctccaccctggtggtcggctcgcggcgcatcgaacgtatcgacgtccactatctggccggggccgacgtgttcaccacaggcaagctcctgcgaaagatcgccgagggggcttcgggccaccgcagcattctacgcatcggcccggccggagaaaacggctcgggctacgcctgcatcaacgtcgacacctaccgccacttcggccgcctcggagccggggcggtcatgggctcgaaaaacctcaaaggcatcgtcatccagggcgacggcgacctgccgctgccggccgacaagggctatgccaagcttttcaaggacatccacgaaaaggtcacatcctccgggatgatggaaaaataccacaaccttggcaccccggccaacgtgttgcccttaaacgaactcaagtcgctgccctggcgcaacctggccgcgacgagcgattccgaggccgacaagatctcgggcgaggcctttgccgaaaagctcctcatgcacaacgctgcctgcgccggctgtccggtgggctgcatccacgtcggcatggtgcgcgagatgttctcctcttcccaccggttcgccatccatcaggtggcctacgaccacgaacccaacttcgcggccggccccatgcttggcgtcgtcgatccggtggaagtgctggcgataaacgacatggccgaccgccagggcctggacatcatctcggccggcgtggccctggcttgggccgtggaggccacgcaaaagggcgtcatttccgaaaaggacaccgaggtgaagctcacctttggcgacgcggctgccctcaaacgcgccatgtggctcatcggccacaaggccaacgacttctatgcgctccttggccagggggccatggtcgccgccgctcattacggcggggccgactacgcctgcgtgctgggccaggaaatggccggctacgccacgggcgagacctattttgcctcccagaccgtcgccttccgccattcccacctcgataccggggcctactcctacgaccagaagcacaaggagcaggacgtggccaaggtggtggacttcctggtcaaggacgagcgcgagcgagtgcttctgacttgcctcgtggcctgccttttcgcccgggaggtctacaagcccgaagtcatcgcctcggtgctcggctgcctgggccatgaggaactggccggctcctttgacgccgccgccgagaatgcccggcgcgcccgctggcggctcaagatcgccaccggctacgaccccagggccacgcgcatccccaaacgcttcaccgaggtgaccacctggaagggtccggtggacgcggtctacatggaggccctgcgggccgcctacgccgaggccgtggccgaactcggcgcgccgcctgccaccgaccaggcccagccgccggctttgtaaaaaacgcagtccccgccgtgcaatggacgcagcgatatgctaggccatacggcatcggccccaaaccggggccgatgccgtattttattcttttttccgcaacaacggcgtgttatggcaatagcgtcgtccggccgcgcccgccccggccaaggccttgatcccaagcccgcgacggtcaaaggagacccgacatggcccaactcaccgagcatccggcccacagcgcccttgtcgcccaccatgagcgcgtgagggacctgcacatgcgcgacctgttcgccgccgattccggccggttcgacaaactttccctgcgcctgggcgacatcctgttcgattattccaagaaccgggtcacggacgagaccctgggcctgctgttcgacctggcccggcaggccggggtggaagcccggcgcgacgccatgttcgccggcgaaaaaatcaaccgcaccgagaaccgggccgtgctccacgtggccctgcgcaaccgggccaaccggcccatcctggtggacggccacgacgtcatgccggacgtcaacaaggtgctcaaccagatgcgcatcttctgcggccgcgtccattccggccagtggaaggggtatagcggcaaggccatcaccgacgtggtcaacatcggcatcggtggttcggacctgggaccgcagatggcgagtctggccctggcccagtatgccgtgcccggcatcacgtcgcatttcgtttccaacgtggacggcgcgcacatggtggaaacgctgcagcgcgtctccccggagacgaccctttttatcatcgcctccaagaccttcaccaccctggagaccatggccaacgcccatgacgcccgggactggtttctcgcccaagccggcgacgaggcggccgtggccaagcatttcgtggccctgtccaccaacgccgaagccgtggccgccttcggcatcgacacggccaacatgttcgccttctgggactgggtcggcgggcgctattccctgtggtcggccattggcctgtccatcgccctggccgtgggcttcgacaactttgaagccatgctcgaaggcgcgtttctcgccgacgagcatttccggtccgcgccacttgagcgcaacattccggtggtcatgggactgctcggcatctggtacaacaattacttcggggcgcagacccaggccatcctgccctatgaccagcacctgacccggttcgccgcctatttccagcaaggcgacatggagagcaacggcaagtccgtcaccaatgacggccggtttgtggactacaccaccggccccatcatctggggcgagccgggcaccaacggccagcacgctttttatcagctgatccatcagggccgaaagctcatcccctgcgatttcctggccgccgccatcacccgcacgcccctgggccggcatcaggacatgctcttgtccaactttttcgcccagaccgaggccctcatgaagggcaagaccgtggacgaagcccgggccgagctggccgacaaggtcttgggtgaagcgcagctggagcttttatccaaggccaagtccttcaccggcaaccgaccgaccaattcgttcctatatcgcgtcctggatcccaagactctgggcacgctgatcgcgctctatgagcacaagatctttgtccagggaaccatctgggacatcaactcctacgaccagatgggcgtggaactcggcaaagtgctggccggaaccatcctcaaggagctggagaatgacgcgccggtggcgtcccacgactgctccaccaatggcctggtcaattactacaaggaattgcgtctgggcgactagtgtcgcgtcccttaaaaatacgacattttttaagaaaaaatttacagtttcaacatgttgtctacgagataccctgtgagtttttcgtgaacgcgacactcgtgtcgcgccccgagccgcagcaaaacgactcctcaggcggccgggagcctgaggcccccggtcccccaaaaggggcaaagaggagatagcgggaagacgtggttaccccgtcagccgcttggccagattcagggcggcggccaggctgctgacggccgccttgcccgtgccgaccagctcgaagcccgtgccatggcccacggaggtgcgcacaaagggcaagccaagggtcacgttgaccgtgtccttgaagtgcaaaagcttcagcggcggcaggccctggtcgtggtacatggccaggatggcggaaaattcgccctgggccgcccggtaaaaaagcgtgtccgccggcagcggccccacggccgaaatgcccttggcccgggccgcctccacggccgggcgcaccaccgcctcatcctcgcggcctaaaagccccccctccccggcatggggattgaggccgcacacggcaatgggcttgtccgccaccccaaggcgcgtaacgtaatcccaggtcagggccagacagcgggccacccgatcgtaggtgaccagcgacggcaccttggccaggggcggatgggtggtgaccaagctcacccgcagcaccgggccgcacaggtgcatgcatacgccgccgcgccccacgcccgaacgctcggccagaaattcggtatggcccggaaaggcgaaaccggcggcattgagcgccgccttggacagcgggccggtgaccagtccccaatccgggtgggcggccagggcggccagggccagctccagactttcgccggcggcccgcccgccttcaggcgtctcctggccaggggacaacggcagcccggccgagccctcaggctccagcagataaatcccgggcgcagcctcggccacggcgtcgtagtcggacaggcgcgtccagaaccgggccagccccaggcgctcggcgtgccagaccagggccgtttccgggccaacaagcaccacaggacggtcgtttttcggcgcgtccgggccgccgagcagccggcagaccagttccggccccaggccgcctgcgtcgccgagggtgagaaggatggggtttttcaaaggggattgggcagtcatgggcttccttccacaacaccaacagccggtgggaagattcccccggcacaggaggtttggggaggaggccgcgcctcctcccgtccatgttcagccttcgggggtcaaggccacggcagccaggggcggcagcgtcagggagaggtattcgggccagtcgccgtacgcggccggccgggccatgacgccgccgccgttgccgatgttgccgccgccgaaaagcgctgcgtcggaattgaatatctcccgccagaacccggggatgcggcagcccacggcgtagttctcgcgcacgatgggcgtgaagttgaacgcccacaagaccggcgatccgtccggggccttgcgcaggaaggtgatgaccgaggcggcgtaatcagacaaatccacccactcgaatccggtccagtcgttgtcgcggtcgtgcatggccggataggccttgtgcagggcattaagcgcccgcaccagttccgccgcgccttggtgattggggaaatccatcagcgcccagtcgaggggctcccgggagttccattccttccactggccgaattcgcagcccatgaacaggagcttcttgcccggatgggcccacatatacgccaaaaacaggcgcaggttggccatttgctgccactggtcgccgggcatcttggaaatgagcgcgcctttgccgtgagtgacctcgtcgtgggacagaggcaggatgaagttctcgtggaaggcgtagagcatggaaaaggtgagttggttttggtggtaaccccggtagatggggtccttggcgaaatagctcagggtgtcgttcatccagcccatgttccacttgaaggtgaaccccaggcctccggtatagaccggccgcgacacaccggcccaggaggtggactcctcggcgatcatggccgcgccggggaaatgctcgtggaccaccacgttgagctcgcgcagcatctcgatggccgcgatgttttccttgccgccgtacttgttgggaatccactgcccttcccggcgggagtagtcgaggtagagcatgctggccacggcatcgatgcgcaggccgtcgagatggaattccttgaaccaatagagcgcgttggccagaaggaagtttttaacctcgtggcgctcgaaattgaagacataggtgccccagtcggggtgctcgccctggcgcggatcttcgtgctcgaaaagcccggtgccgtcgaagcggcccagactccaggcgtccttgggaaaatgggccggcacccagtcgaggatgacgccaatgccgttttggtggcagacgtcgatcaagtagcgcaggtcctcgggcgtgccgaagcgcgaggtcggggaaaaatagtggccgacctggtagccccaggattcgtccaggggatgttcggccaggggcatgaattcgatgtgggtgaaacccaggtcgcgcacgtagggcaccagggtctcggccaggtcgcggtaggagtagaacgagccgtagtcggcggttttccagcgccaggagccggcatggacttcatagatggccaccggatcggtcaggggcaggccgcgcgcccggcgctgcttcatccaggccccgtcgttccaggcgtagctgtccagatcccaggcccgggcggccacaccaggccgcatttcggtgcaaaaggcgaagggatcggccttttccactaccgcgccgtctagctggatgacggaaaatttgtagagccagcctttctcgaaacccgggatgcagccggcccagatgcccgaggcggccacgggatgcagggcttgagccccgggggtccagccgttggcgtcgcttataaccgacacggcccgggcgttgggggcccagacggcgaaccggtagcccggtccgtccggcccatcgtagggatgcgcgcccaggagccggtagaggtcccaatgtttgccctggccgaagaggaagatgtcgagttcgcccagggccacgggcaggcagggcgacacggacgaagcggcggctttggacatgggaactcctttggcgggcgggacggcccttggtccaggcggtcccggcgcgtcggatcaggtgtcgccttcacggagcgcacaacgccgctcacgagcaaggcggtaaacaacgctcgatttcttcaggttgcgccacaagaccgagccgacggcaatgccgtgtcggcctcgtagcggctcagatgtcggctccaagctcccggtagagattgatgtaattcttggccgctttttcccaggaataatcagcccgcatggcccttacgaccatggccttccaggcttcggggcggtcccagagttccagggcgtcgagaatggcccggtagaagagttcggggtcgggttcggaaaaggtgaatcccgtggccgcgggatcgggccagggcacgatggtgtcgcgcagcccgcccacggccgtggccacgggcggtgtgccgaagcgcaaggcgtacatctgggtcaggccgcaaggctcgtagcgcgagggcatgaggaaaatgtccgaaccggcctggatgcgatgggccaggtcttcggtatagccgatgcgcacggccagccgtccggggtaattttccatcatgtccaacagcacggcctcgtagtcgaggctgccttcgccaaggaccaccacggcggcgtccttttccatgacgcggcccatgatgtcgatcaacagatcaatgcctttctggtcgcggatgcggccgatgaagcccaggattggccgcttgaggaaccggcggtccagccccagctcggccacgaggtttcgcttgcacacggccttgcccgaaaggtcgtcggggctgtaggcgcttggcaggtggcggtcgtttatggggtcccagacggtgtagtccgcgccgtttaagatgccgcgcagctgcgaggcgcgcttggtcaggatgccttccaggccgcaaccgaactggggcgagaggatctccagggcgtaggtggggctgaccgccgtaatgatgtcggaataggccaggccggccttcagcaggttgaaatcaccccagaattccgcgccgtccaggccccaggcctccttgggcaggcccgagtcgaagaacagccgtgaggcgaaacggccctggaaggccaggttgtgaatggtcatgacggttttggtgttgcgccaaaagggcgctgccggacgcaggaagtgcaggtaggccggcaccagggcggcctgccagtcgtgggcgtggacgatggccggcgcgccgtccagccggctggcccaggccatggtggcccggcagaagaagatgaagcgttcgcagttgtcgaaatagtcgccgtcgtgggtgttgtagtagaaccggcggtcgaagtattcgccgcgctggacgaagtagaccggcacgtcgtcgcaggtggcggtgtagatgtcggcggtgatgggcgcccaggggtagccgacgcggcatttggaatagatcagccgcagctggtggtcgccgtggttgaggcggccgtagtagggcgcgatcagggcgacgttgacgccctgacgcttcagttccttgggcagcgcgcccatgacgtccccgagaccgccggtcttggagaagggatacatttccgaagcgacaaagaggaccttgtgatgaaacttcatcgcgctcctcggcagggccggttctcttccccttgcgcacggccatccgcgggagtggggaatgtggtccgttactcccgtcaaccgccccgggcggcgttcggggctacaaggcgcggcggaagttcttcgccgcgtccttgtctggctggcggccgcttcacagcggtttgacccggttcaaaagcgtggcatagtcgttgagaatacgttcatggtcgaagcacaagggcttcggccactgccccacgggaaagacggacaggttcttggcgtcgtcgccggcggccagttcgtcggggtccagggcctgggcaatgtagacgacgctcaaggtatgctgcctggggtcacgcgaggggtgggaatagacgccaagtaagctcgtcagttccacggtaaggccggtttcttccttggcctcgcggatggcggcggcctcggccgattcgccgtagtccacgaacccgccgggcagcgcccagccgtaaggctcattgaggcgttcgatgagcaccacgccgcgtccgggcagatgaatgagcgtgtccacggtgggcacgggattgcggtaatggacgatggagtggccgcattgcgggcagggtttgacaagggccatgatcacatgctccaggcggacgcggtggttgtctgcgggcggttgcccggcccggtttcccgaaaaagtctcaagcaattataaagatacgtctttttctatctccaagggtacgcgaaatgaacccccctgacaagatcgttttggaacatgccggagcgcttggcgattttttcctggcttggccggcttttctgtcggtggtccggcgttttccgggtgctgcggcctttgctgccgtgcgtccgtccctggccggctacctcgctcccctggccgcgccctgcccgcccgacctgcgtcgaaccctcgacgcccgcttcgccgccgccgtctggcccaaggccctggccaataccctggtgatccgccccggcctggctgctcggccggagctgccgccaagcgaccgttttctgttcttgcctggcgtcgtgcccggcagtctggagagccctcgggggcactaccgcaaggccctggaaacccacggtatcccctgggccgaggactggcgcgagatgttccaaacgcttttcggaagccatgcaccgaccacggacgacgtgctgctttttcccggagccggccacccggacaagtgctggcccctggaccggctggccgccctggccaaggggctggccgcgcgcgggctgcgcccggtttatgttctgggaccggcggaactggaacgcggccttgccccggccggaagcaacatgatgttgctcgagacggtggaagaattgtcgttggcgctgcgcgcggcccgggcggtggtggggccggactgcggccccctgcatctggccggcctgcacggcgtgcctggggtggcggtcttcggcccgacctcgccccggcagtggggtccggtcggcctggacgtcataacggcggggatggcctgcgcgccctgcgcggtcgtaacgtccggggcctttgccgccgcctgcccgcgccccctgccctgcctggcgggcgttggccacgaggccgttctggaacggcttatggccctgacggtagcgagaccacgcgccggtcaatacgggaagtgaaacgggtcagctcgtgacgttctcaggcaggtagccggccgccttcagggcggataacggcgtcgcgccccggcggaaaatggtcaggcgcttgccgccgcgcaggccggccacggtggaggccgggccgccggccgggggtgcgccagcggtcagcaccgcgtccacggccgccgtcacttccgggtccagtgcttcaggcgtggcagctggcgggccgccgctgacgttggcgctggtggccaccaacgcgccgccggccaagcggcaaagcgccgccgctgtttcgtggggcgtgaagcgcaccgacacccgaccgtcggcgtccttgaccagcccgggcagcgcttcacggcacgggaccaccaaggacagcgggccgggccaaaaaagcgcggccagttcgccgaaatcggccccaagcggtccggcggcaaagcccggcggcacgaccgcggcgagctgggccagctctccgaccaaaagcggcaagggcttgtgggcaggccgtcccttgacggcgacgatgcgctccagggcggcggcgttgtccgccagcgcgcccagggcgaaataggtttccgtgggatagaccacgcaaccgccggcgcgcaggatggctgccgcccgggccagggatgtcgtgtgcatgaatgcgccttggtgtttgccgcgtcccgacgcgccggccagacggcggttggacttgccgccccggacgggctatgggccaaggcaacctagcaccaatgctcccaagggaaaaggaccgccatgcccatcgatccgcgccgccctgccctgccgccgctgccgacgccctcgccccattttctgccagccgtcctggacgccctgccctattgggcgctgaccaccgaacaacaggaactgcgccgctccctggccggcctgctcctggcccagggagcgggccagcccgactgcgccgccgccgccaaggggctgctcgcctacgccgtccagcgcgccccttttgaccgggagagtctggcacttacggcccaaacccaggccgccgccccgtttttgccggccaaggcggcggcagtggccgacctgctggcgtcgctgccgaatatggacaacgacgagatctcttacgcggccatcgctgccagcggtgatcaagaactcctcatccgctacctggaaatcgccgcccgtgacaacaccgccggcctggcccggctggccccggccttccaggcgctttgtcgcctgcccgatgttgaccaggccgaggcgctcctggccggctttgccccggtcgtgccgccgccgctttttgcccgcctggaggccgaattggccttgctgcgccgctcccccgaggccgccctggaaaagctgctcgccctggacggcgatgcctggggactgtttgccctggtcggcgcgtcccactgccaggaacgcctcggcgaccggacggctgcccttacggcctgtctggccgtccggcgcgtcctgccccagcacgtcaacctcacacttcgggccttcgaactgtcgcgcacacgcgaaacgccgcgcccggcccgggccggcgaggcggcggtgtgcctgtattccatgaataaggaagcgcttttccgggagtgcctgacccacctggccgccacagaccttggcgaggccacggttgcggtcctggacaacggctccaccgacggcaccggggccatgctcgaagccatcgccgaccttttcccggccggccggttcgtcatcgtgcgtctgccggtcaacatcggcgcgcccggagcgcgcaattggctcctgtccgtgcccgaggtggcgacatgtcaacatgtcgcctttctcgacgacgacgcttttcccgaacgcgactggctctcgcgcctgctggccacggcccgggagcatccccagaccggggcgatcggttgcgccatcaccgactgcgagccgccgcgcgaccaccaatcggccgacttcaacctctttccgccccagatgggccggccgtccatggccgaggtcaaggagcggctttttgtctgcgaaccctgccggggcgcggccgatgtcgggcttttcgcctacacgcggccctgcctgtcggtgtcgggctgctgccatctgctttcgcgggaagccctccagggggccggccccttcgacatccgcttcaatcccacccagttcgacgatctggagcgtgacatccgctcctttctggccggattccccagcgtctacgacgggaccgtgcgggtgcgccacaagcagggatcgagcctggccctggcccagacccaggcccaagtgagccaggtgctcggcaacaagatcaagctcgaatactgcgtgtccgacgccgacgccgaccggctgtggcgcgacaacttggcgctgttaggcaaggatttaaaggagaaggctgcggctgtggaggcgcttggggtgtaggcaataatcggggctctgccccgcgccccgccggggggatgatccccccggacccctctattgatggagagcgattagtccagcgtctggcggtagcgcttgatcccgatccccaccgacacgagcaggaaaagcccgatgggccacatgtgcggcacgatgtccacaaacgtgttgcccttgagcacgatgccccgcaccacccgcagatagtgggtgagcggcagaaccgaacccagccactgggcccactggggcatgccttgaaagggaaacatgaagccggacagcaggattgagggcagaaaaaagaaaaacgacatctgcacggcctgcaactggttctgggcgatggtggaaaaggtgatgcccacgcccaggttggccgcgatgaagggaaaggacaccagaaacagcagcggcaggctgcctacgaaaggcacggcgaacaacagcctggccgccaccacgataaggcccatctggatgtagccgacaacaatatagggcaggatcttgccaagcagcacttccgtgggccgcaccggggtgatgagcaggttctccatggtgccccgctcgcgctcgcgggtgatggccagcgaagtgatgatgaccagcgtcatggtcagcaccacgcccatgagcccgggcacgatgttgtactgggtcacggcctcggggttgtagcgggcgtgcagccgcagatcgaccggcccgtccttggcccgaaggggcagcaacggtccggtgaggtcgcggttgaaggcgtcggtggccgcctgacggatggcggccacggcgttggaggtggcggccggatcggtggcgtcggcttcgagcagggcaaccgggcgcacgccccgaaccagatcgcggccgaagttctgggggatggtcaggacgaactggatgcggcccaggcgcaacagctcgtcggcctcggcttcggtcctgatttccttggtgaacttgaaatagtcgctgtttttcatggctgcggccatgtcccgggaaaagaccgaacggtcgttgtccaggatggccgtgggcagctgtttggggtcggaattgatggcgaaaccaaacaggatgagctgcaaaagcggaattcccaccatcatggcaaaggtcacccggtcccggcgcatctgggtaaattccttggacaccatggccccgaaccgggccggggagaagccgaggaagccggacatcacgacaccgccttgcgcatgaggctgatgaagacctcttcgaggttggaggcaatgcgccgcagggtcagcggcgccgcgccgtaaggggcgaggcttgcggccaacgcgtcgccgtcgcggccgctgacgtgcagcgtcacgccaaaggccaccacctgttcgactccgggcaggccgcgcagcttgtcgatgtagccgtagaggtcggggccgcttatttcgtaggtgaaaagcccttcctgggccacgatctcgcccaccgtgccggtggccagcagatggccgtaggcgatgtaggccagccggtggcagcgctcggcctcgtccatgtaatgggtggagataagggcggtgatgccctcgccggccagcttgtggacctcgtcccagaaatcccggcgggccatgggatcgaccccggccgtgggttcgtccaggagcagcaggctcggctggtggatcatgcaggcggccagggccaggcgctgtttccagcctcccgagagcgtgccggccagttggtcgcgaaaccggcccaggttcatgcgttcgacggtgcgggcaaccccggccgcccggtcggccacggcgtacatgcgggcgatgaaatcaaggttttcccgcacggtcatgtcttcatagagggaaaacttctgggacatgtagcccacatgaggctttatcaactcggcctgctcccgcacgtcgaagcccagacacgtgccatggccgtcgtcgggacgcagcaacccgcacaacatgcgaataaacgtggtcttgcccgagccgttggggccaagaaaaccgtagatttcgccccgattgacccgcatgtcgatgtgatcgaccacggtcttgcggccaaaaatcttggtcagcccggtcacgtcgatgacggccggcgaaactccggcgttcacggcttggcccctgtcatggccggctccagagagacgtcgatgggcaggcctgggtgcaggcgcggcgcgacggcgggatcaaaggacgcctccaccatgaccacgagcttttcccggaagccctggctgtaaatgaccggcggggtgtattccaccttgggcgcgatgtagctgatggtcgccgtaaccgcctcgccgcccccgtcccaggccacgcggacggactggccgggcttaaggcccccggccacggcttcgggcacgaaaaaccgggccttgacgttggcgtcgggcaacagcaccaccaccgggctgccggccgccgtccactcgccccggtagtggagcagatcgtagaccagtccgccgaccagggcggactggcgcatctggtcgaggttccaccttgcctgggcgaccatggcccgggccgcgtccacggcatcggccgccgcccggatctggtcgatgcggctgggcagcttgcccgtggccagcttggcctccagctcccggacctgctgcttgtcgcgggtgtgggtggtgcgcgaggtgtcgagctcctcctgggcgatgaccgcgctgccgtagagcttgacgcggcggtcgtattccagccgcgacagctcgcgggcagcctcggcccggcgcagatcggcctcgatctggtcgatctcctcgggccgcagccccttcttgcggtcgtccagggtggcctcggcctggcgcagatcggcctgggcctgagccagggcggctgcctcgaaagcatgttccagcacgtagagcggctggcccggggtcacacgctgcccgcgcgaaacggccaattcgtcgagccggccgccgatcttgccggccacatacacgaattcgccctccacatagccctgatagctcgtctggccgtcaggcttgcagccgccaagaccgcacacggccatcaggcacagcgcagcgcagaaatatgctctcatgccccgccctccttgggttccgcagccagcccccgggtcagcacgccggccaaaaaagcgcccatttccccaaccggcatgtccgtgcgcattcccatggcctgggccacctgggcaaagcgctggcgcagcggctcggacaggctgtagacgatcatgccgccgaccaacgtcagatgcacgaaaaccggctcggccggccgcagcagcccggtctcctgcccccgggccaggatgccccgggtgacgccgaaaatgcggcgaaattccatcatggccgccgccggcatgttggccgcgcccgaggccatctccaaagccatgatacgcggcaacatgggcaggcgggaaaacagaccggccagagcctcggccagggcggccagggcctcgcccggcgacagcccgggcacggccgcctgctccaccgccccggccacctggccgaaaagccggagcatcacggcttcgtagagcttttccttgttgcccacatgataatacaggccggccttgttgaccccggctcgcttggcgatagcctcgaccttggccccggcaaacccctggccggcgaactcctcggcggcggcatccaggatgcgggaaacgatgtccgatacggcgtccatggcatgccccctctcttaaccgtttagttcaaaattttggttaaaccggaacgtccaaaccgtcaaggggaacatgaacgccgcttcccatttggattaaagcagtgtaatccgtgagccggccggcaggagacaaccacgccccggcccaaggcgcccatgacccagaccgccctttccgtgcttttatcccccgcgaccgctttgggccgcgtgaccctgcgcttcgtggccgagcttggcgggctgttcctgttcacgctccagggactttggcgcatccttgtcccggccccgtcctggtccaaaatcgtgcagcaggtctatttcatcggcgtcaagtcgatcttcgtcatcgcgctcatcggacttttcacgggcatggtgctggggctgcagggctattacaccctggtcaagttcggcagcgagggccttcttggcgcggccgtggccctgtccatcatccgcgagctcgggccggtcctgaccgccatcatgatcaccggccgggccggctcgtccatggcggcggaactgggcatcatgcgcatttccgaacagatcgacgccctgtccaccatggacatcaaccccatgcgctttctggtggcccccaggctggccgcatcgcttatttgctttcccctgctgacggccattttcgacgtggtcggcatcctgggcggctatctttcgggctgcgtgctcctgggcatcaatccgggcgtgtatttcgaccgcatcgacgccactgtggaactggccgacgtgaccggcgggttcgtcaaatccgtggtgttcgccctgctcgtggccgtcatctgctgctacgaggggtatttcacccatgcccgccagggcggtttcggagccaagggcgtgagcctggccaccacctcggcggtggtcctgtcgtgcgtggtcatcctggtcgcggactatgtcctgacctcgtttttgctgtagaaaggggccggcgtgttgcatcccggacacgttggccgtaaaaggccggttgcatgaaaaaatacgcaatggaaacgtccgtgggcgtctttgtcctggctggcctcttgtgcgtggcctatctgacggtcaaactcggcaagctggaggtggtcggcggcgacggctatcaggtcacagccaagttcaaggacgtcaccggcctcaaaaacggcgcgtacgtggagatggccggcgtgcgcattggccgggtttcgggcatccgccttgatcccaaggaccatgccgccctggtgggcctgaccctggacaaggacgtgcggctgaccgacgacgccatcgcctccatcaagaccagcggccttatcggcgacaagttcgtcaagatttccccgggcgggtccgatgacgcgctcacgcccggcggcatgatcgtcgagaccgagtcttcggtcgatctcggcgatcttatcggcaaatacgttttcggcggcgtgaagtagcccttccccgcaccctcggcatcctcacagcggtggtatccggtatgcagcgtttcgtttcccgcctcgttttgacccttgtcctgctggccgcgaccgtggccggcgcccaggccggaccggccaccgacaccctgtcccagtccgtggacaaaatcatcgccctgctggccgatccggcctacaaggcgtccgatacccgaccagccatgcgggccaagctcatcgccgccatcggcgaaatcttcgacatgaaggaactctcccgccgcgctctggggccggagtggaacaagttcaaccccgagcagcaggagcggttcgtcaaggccttcggcacgctgctggaaaacacctatctcgacaagatcgagagctacaccgacgaaaaggtgcagtacctcacggagcaggacctcggcggcggcaaggccgaagtgagcaccaaggtcatgggcaagggcaaggagattcccattgcctaccgcctgaccgatcgcggcggctggaaggtctacgacgtggtcattgaaggcgtcagcctggtgcagaactaccgcagccagtttggccagctcctcatgaacgagagtcccgacgccgtgatcgccaagatctcgcaaaaacgctcctgaccctaaatttcgaaagcattccgccaattggtcgtgattaggttttgacatgccctggcccgtgaggcactaccgaagagaagttcgacgctttggatggcttgcctttcccgcaacgctgaaccgtgtggagttgccatgaccgccgccttgtcccgaaaaagccttcttcccctgctcctgctgtcggtcctggtcatgaccggctgcaacggccgccaaaagaccagcaaggatttcgacaaggctgtcgcgccgactcccgccgccgtccagacgccggcccaggctccgacccagacggccgccgccccggcctcgaccgaaaccgtcgccgccaagccggccgccgcgcccgtggccgccgtcacccagacggccccggccacgccccaggctgacgactacgcggaaacgccctacaagcccacgcctgatccgctctattattggaacaagacctggttcaaattcaatgacctcttctacagcggcctcatgcggccctttgccaagggctacgcctttgtggtgcccaaacaggtgcgcagcgggctgaccaacgcctaccagaacttcatcttccccatccgcttcttaaacgccctgctccaactggacttcaagaaagcttccaaggagttcgggcgtttcatgatcaacagcaccctgggcatcggcggtctggtcgatgtggccaaggccgatcccaacctggccccgggcaacgaagacttcggccagaccctgggccgctggggcgttggcgacggcttctacattgtctggccgctgcttggcccctccaccgcccgcgacaccatcggcatggccggcgacgccgccgccaatccgctgacctggatcttcggcccctggtccatctacggcgacgacaatccctggtactggtcctacatcatcaagggcgcggacgtgttcaacaacttgccgaacacgctcgaagcctacgacgccgtggtcaagccggcggtcgatccctacaccgccgtcaaggacgcctatatccagtacaggcgaaacgccgtctcccagtaaccgccgcgacatccgacgccgccgcgcccccgggcgcggcggcgtttttcatggatcaggcccgattccatgcccgtccaagacaagtcctcggatctgccccgacacagccagcctgccacagccaaggctgaaggacggcttcctggttccgacgccgcaaccgccctgcgcctgcccttgctcggcggcgtcctggccctttgcgccagctaccgcacccaacgtttttcccgccatgtccatgaagaatacgccctgggccgcatcgaagccggggccttgagcttccgttaccggggcgcccgggtggtggctccggccggcagcctgtccctggcccagccgggcgtgccacacgacggcggaccggccgtgcccgaaggctggcgctaccacatgctctatctcccgccgacggccctggcccaagccctgccggccggcgcgagcctgccgcactttcgccccggcgttattgaggacgccgccctggccgacctgttcggccgtgtccatggcctgctcatgacgccccaggccccgagcctggccaaacagacgcgtctgctcgccctgctggccgcctggatcgcccgccacggcgacgaccatccggccgccccgcccatcggccgggaaccgggagccgtgggccagacactggccatcctggccgagcgctttgccgaagatgtgcgcctggaggaactggccgccgcgaccggcctgtccccctggcatctggcccgggccgtgacccgccataccggactgccgccccatgcccatctgctggagtaccgctgccgggccgcccgggatcgcctgaccggaccggaatccctggccgacatcgccctggccgtgggttttgccgaccaaagccacctgacccgggttttccgtgcccggttcggcctgcctcccggagcctggcgcaagatcgttcaagaaaagcaccgccgtccccgttagcttccgccatcctgacgatggcggaggttttgccatgtcttcccgcataaaagcggtcgcgtccctgatcgcggccatggtcctggtcggctcgtccgtggccgtgggccgctccatgacggccgcgctgccgctgtcctttgcttccctggcccggttcgtcctggctagcctggtgctcgtacccctggtggtagtcgtcgagggacgctttccccgggtgtcgcggcgcaccttttacgccttgttggcccaggctgcttgcggctcctttgccttcacggcctgcctgctctcgggccttaagttgaccggagccgcctcggccggggtcacggccgcggccacgccggccgttgtcacgctccttggggccatctgtttcaaggaaatccctggccgtttggccctggccggcatcggctgcgtcacggccgggctggcggtcctgggtctcgcgtccggtgggccggtcatcggcccggctcccttctggggcaacgccctggtgcttctggccgtgtgcttcgaggcggtgtttttgctcctgcgccgcaccgtgcgcgagccgctgtcccccctggccgccgccatgtgggtgtcgcttctgggcggactcttctttcttgtccccggcgtctgcgaggccctgaccctggacctcggccatatcccgccacgcgccgtgggcgaggtcgtctactacggcctgggggtcacggcggcggcctacatgttctggttttacggcgtggtgcgggtggatgcggccacggccggcgtggcctgcggcgtcatgcccgtggccgccctggcctgtgccgcgctgtggtgcggggaaaccattggctggcgggaaatggccggctgcgccggggtgttggccggcattctgtgcctggccggcggagcgcgaaaaaaaaacggggcggtccgggattcgcatccctgaccgccccggaaaaagcgtccatggtggccccggcgggcttatgatccgccggccttgggcggcggcggcacgtagccgtcgggcaggggcggggccggctcgacaatgggcggcgggatgttacccgagggcttgggcgacggagccttggccgtgcccgtggcggccggggccgttttggccgacccggccgcgccggacttgggcgcgccgccccggtccaggggccgctcctcggtcaggtgcggttcggtgacgccggcggcgaaaagctcgccctcaagctcggcccggttgccttccttgacggcgtagaccttgaaaaacgtcttgttgttgagcttgccctggtcgatgcgggtggaaaacccgcgcgactccagggcgttcatgagctccgaggctttttccttgtgggcgaatgaaccggccatgaaggtaaacgtcgcccggtccgacggcgcgccggccggttcttccgaagccgggccggccggttcgggcatgggagcaggacgcgcggcggcaggcgcggccatcgccgcagcctgcccgctggcggccgcgggagcgccggaataaccagcctgggacgcggcggcctgttcggcctcggccgcaccgggcttgaagggcttgggcgcgaaacgggggtcggtcacggtcggggccggctccaccacgggcggcgcgatggtccgtcccgtcccgcccgaggcagccggcatggccggcgcggcggcagccggtgccgcctgggccggaagcggccgggaagcgaccggcgcgggcggtggcggtggggcatacggagccggagtgtaggccgggggcggcggaggcggcggtgtggcggactggcgcggccagcccgtgtcggtaggagattcgggagcctgttgcccccagatctccttttcgaaatccttgttgttggaagcgcagccagacaggccaaaggccagcaggagcgccgcgataggtatacgacggttcaaggggactcctccctgataaggacgaagccggcagggccgcgtcagcagatgcccgccaaccggctcaaggtttccctggcggcgttgaatcggccgatggccagggccagggcttcggcggtttgctgtctggccgccgtttccacggcggccgccgctcggctgagcgcctcggcgccgatggaggcggcggaactcttgatggtatgggcctgcaaggccacgccgtccaggtctcccgaagcataggccgcatctaggaggctgcgcctgcggctcacctcatcccagatgcagtcgaacacgcgccgaaagccgtcggcgtccacacccatatggcgacgcgcggcttcaggatcaaacgtcgccggacgacgggcggcggtttccccatgttcctcgtcggctgccataaacgtcattccttgggcatgttcagtcgagaaacaccacttcggtgccgacgtcgatcaacttggccatgtccttgccctcgtcgttgcgcatgcggatgcagccgctggtgacgggccggccgatggagttgggattgttgttgccgtggatgcgaaaaccgtagccatgggacaggatgatcttgaacggtcccatgggattgtccttgaccccggggccaacgtattcgggcaggggtttgccttttttaagcgcccgttccttcatggccggcgtgggccgccaggaaggctcgaaactgatgcccgtgaccacgccccagccctggggcgcttccatgtcccggcccggcacggccaccacgtagcttcgggccagatggcgcgatccatcaggcagattttcatagaggaaaagcttgcgctgggacagatggacctcgatggaataatgattcttgcgggcattgtaggcggcggcgtcttccggggccacgggttcgccggtggtctgggacggggccagggtggccaggaagcggtccaacccgccgccgtcggccaccggcgcataggccatggcgggcgcggaggcggccggttttaccgcaaccggcgcggccgagggtttggccgccgctttggcgacaggctcctgggttgatgtcccggtagtcccctgcacaaacgccacttccttgggacgcattgcctcagtgggctgttccgtcgccccgcacggcgtcgcggccgccaaagccagcgccgcgatcccgaaaatccatccccgcatcgttcccatcctccgacgcatccagtcgcccgcactgtccggccttgccataaaccgtccgtcccgacaagcccaaacggaatcaagcggttttataccgcaccagcggtcgccgccggccggccggccgggcataggccacggccggccagcccagggccaaaacggcatggacggtttcctctcgaggcaaccccgccgccgccttgacccgcttgtcgtgacgcatggcctcaacagcgtagccgataaggcaggagccaagccccaggcagtgggcggccaaaagcatgttgcccgtggccaacagcgcatcctcggccggacagcttgccccgggtctggagccgaccaccaccacggccgtggccccgtgaaaaagccggtccgtgcggtcgcgctcccaggcggccaacgcctcggccaccgacgcataatgctcgcggtagtagtcttccagctcccggcgacccaggagggcgtagcctttgcgcacgagccgattggcggccaggcgattgacgcggccgaaaaagccggccacggcctggcccaggctcatgaccgccgcccgggtggccagcaccgtgaaggtccaggcctgggaattggtgcccgacggcgcggtgattccggcgcgaatcacatcctcaatgacggggccgggcacggggcgctccagatagcgccggcaggaacgccgggagcgcataatgtcgaccagccggccggcctggcagccgcccggggcgatctgctcgccagagggctcgatgacgtcgtaggcctgggcccagggatcgtcgccgggaatggtcagggcgcactggggacacacggcccggcactggccgcagccgatgcagccggccccggccaccaccaccaggccgtcgcccagggacaacaccccggacggacagaccgtcacgcactccccgcagcccacgcaggcggcggcgtccagtatcggcgaatcactccccatgcgaaccatgccttttttttgcgaaaactatttccgtcccgccttgcgagacgtcgcgccggcctcaggagaaccggcctcggtcccgggggcgcgcggcaggcggcgggcggccacgaaccagcgttcgtaatccgtgccggaaagcttgtccacgcccacgccgccacgcctaggactggaatggagcatccggccgctgccgagatagatgccgacatggctgatgccgacgtccagattggtggcgaaaaaaagcaggtcgcccggggccagttcggccgtggccacggccgaccccagcccggcctggagccggctttgccggggcagggagcagccgaaaatggcgtagacagccttggtcaggcccgagcagtcgatgccggccggggtatcgccgcccagacggtagggcgcgcccaggtaaggctcggccgcgcgaaggatgcgctccccgacttcggacagcggtcccatgtcggccggcagcacagccccccgggtgatcggcggcccgcccagggcgttttgctcccgcagcgccttgaccagggcctcatggtcggccttggcctcgctgtcgtagagcggtttgtagtgctcgcttaacttgttcggactcgtatggagcatgcccaggctgtcttcatagccgtagacggtgcgcgcctgggccggcaaggcggcccaaagcgacaggcagcaacaggccgccgccagcaagcgacgcgcggcgaaaatggggcggcgcatcagctgcccccgtagacgaagcggcggccgtcgtcgatacgcagggttttgacgcattcccgtcgaaaggcgcacagctcctggccgcaacggtcatggacgccccaggcgaagcacggggcaaagccttcgcgctgctggatggagcgcacggcgtcgatggtggtcagccccgagacgtccaggcccagttcccgggccttggtcatgagttcgcgcacgtccaggcccatgggaccataaaaggcctcgcgccccaggcccgcctcaggggtgtcgaaaagccgcaccgccaccaccgccccaccgccatcgccctggcgcaggtcgatttcgccgttgtgttccagcacggccttgcgggccagggtcaggccgatgccggctccccgggccttggtggtgaaaaagggatcaaagacaaacgagcgcagttcaggccgcaccccgggtccgtcgtcggcgacggtgagttggctgacgtcgtcgcgccgggccagattgatggacacgcgcacgcgttcatggccggaaaattccacggcattcagcaacacctcgtccagggccagggagagcaaggcctcgtcagccacgatctccacgtcttccagggaaatatggctctccagacgtttgtggaggccttcggcgctgcgggcggcccgggaaagggcctcttccaccagccggcccaggcgcacggcggcaaaccgggggctgccaagggtcgacaggcgcaccaccgcgccgaccagatcttccagccgccgggcttcctggaagatgatctcgggatattccacgggcaggcggcgttccttgtggtcgcgcaggagtttgagcgcgaagccgccgatggccgcggccggattgcgcacctggtgggccacggacagggccaggttgttgaggctctcgatcatgtcgtgctggaggcggtttttttcgcgaagggcggcgttttcccgctcgcggctgcgatacagcgccgtgacgtcgtcaaaaaggagggtgacgccaataggcttgccgtcaacgctcggacaggtggcggtcatggaaaagcggcgcatctcgccgtccgggcgctggtaatcggccagacactggcggtagggccgtccgctttccacggcttcgacgagattgcgattaaacgattcattggccggggcgggcagaagcagcgtatgccaatcgcatccctcaaggctggcttcgggcaggccaagcagataggccgccgagggactggcggcgatgaccgtgccgcgcggaccgatgacgagcaggcccacgggtatggtcttgatgacgttttgaacgagtatttgtctgacgcttggcatggcgcttcccggccccttggagacgactcatccaaagtaggcccgcttcggtccgatgacaagaccggaccgaagcggagcgcaacacgaacggggggaggatcttactggttcttggccgcagccggggtcttggccgccacgccgacgaattcgtcaaaaacttcgtagggaacggccccacgcaccggcgcgccgtttatgaggaacactggagtgccttcgaaaccgaagtcccgggcttccttggtgtcggcggcgacccggtcggcaagcgccttgcttttgacgtcctcggccagcttcttggcgtccgcgccgacttccttggcaatcgcgtcaaggacttcgtcgcccttctcggccacgtccttttgccgagcaaagaccttgtccatgaagttccaggccttcttggcgtcctgctgggcgatggcctcgaaatagagcgcggcccgcacgctgtttttacccgtggcaaagtgtttgaacaccagccggacgtcgtcagggcgtttttccatcacgcttttgacggtgcccgaggcctggccgcaaaagtggcacaggaaatcggaatattccacgatggtcaccggggcgttttgcggaccaagcgcaacccggccggcctccatgaccggcgtgaggggcttggccagggcctggctgaagcgcgctcgctccaggtctttctggcgcgcccgggccgtggtctcgatgacttccaaaacggccggaccctgctggcgaatggcctcgaccacgatttcaggatgttcgcgcagcaccttgcgaacccgctccaggtcgtcgtcggccgcggccggcatggccgtaaggccaataacggccagcgcgacgagcactttccatttgcccatgcttcctccagatagcgcgccgtgacagcgctttcgatgccgcccgtcatagaccctttcgcccgggctgtcatccgttgcccatcgacgccacgcggggcacgtggtaggctggcgccatggaatggcttattctcctggccgcgctggtggccggcctattcgccttttgcctcagcggggccaagcagcagcccggcggaacctgactgcccgagacctgtcgccgtcggcgaccgcctgaacaaacgccatcagctgccgatgacgccggccgcccccggccgtgaggaccgcccatgctttgccgcccccctcgccatcccctcgccgccctcgccctggccctctgggtcgtaccagccttgttggccgcttgtgaaagccagcctacaaccgatcccgaccgcaaggccaaagcctacgccctgtacgaaggctacaaaaaggattttcccgaggctggggcaatacgtcccgaggaagccttgaaactgcggcaagacggtggcgtggtcttcatcgacgcccgctctgaggcggaacgggccgtgtccaccctgcccggagcgatcaccgagcaagactatctggccgacccgggccgatttgccggaaagcaggccgtcatctactgcaccatcggctaccgtagcggggtgctggtccagaaacttgcggccaagggcatggccgccgccaatctggctgccgggatagtgggctggctccacgccgggggaagcctcgtcgacgcctctggcgcaccgaccagacgcgtccatgtctacggccgcacctgggatctcgcccccctggcttacacggccgtctggtagggccgccggccggccgatcggcggtttccgtcaggccgggatacgccgcgcctcacctttcatccgcgcaaccctgcgccttttccccaaaacacgcctccggctcccggccgtaatagcggcggtagtagcgccggcccgtggcgtcggccaagcccaaccgccgggcggccagatagcccaggcacatggccacgacaccggccgccttgccgccaaagcccgagccgacccagcgccggcccgaggccgtgacgccgccgcccaggcacagcgtctccccggcctggcgcaggagcaaggacagttccacgtcttccatgagggccagggccggaaatccgccggcgtcctccagggcctcgcgccggaaaaactggccctggtcgccgaagccaataccgcaaaaccgcgcccgcagggcattgagcagcccaaggacgccgagcccgtaacggcgcgtgtcgtaggtcatgccgaccacgccgccgaccgcctcggggcaacggtccaaagcggccagaatccgggctggcacgtcgggggcgatcacggcgtcggcgtgcagaacaaggaccacctcgccccggcaggcggccaagccagccgcgatctgcccgccccgcccgccgcccgccgcgacgactttcgcgccaaatccggcggccagggaaggcgtgccgtcggtggagccgccgtcggccaccacgacctcgtgcacccccgtgccgtccaggctttccagacagcgcacaagccccctgccctcgttacgggtcggcacgacgaccgagagccgccgtggtctttgcgcggggccgatcgggacggccagcccgggtcgccaggcggaaagggccaggagcaacaagaacggcagccagatcgtggccatggccagtccctggccgccaagttcctgggcgcgaagccaggtcggggtcacggccaaaccttgagcggccaggagccatagggcaggccagcccggacgcagggtccacagcggcaggaccatgagcaaataccagggatagaccgtgggcaaagcggcaaggccgaccagaccggcgaaaagcggcccgcgcccccgatcctggaaggccaaccaaccggccatgagcaccgcgccgccaaggcccagggacacggccggggccagggagccgcacagaggccagaccagggccgtcaacggtccgccctgagccaggtagccggcaaaggcggcaagcgactgaaaaaaggccgggccagccgcgcggtaaggccaaaagctcgccagcggcacgagacaggaggcggcctggcgcagattgcccggccgcaaaaaaaaaggaatgagcagcaaaactggatacttcactagcccggccgcgcccaggcacaaaaaaccccagccgtcgcggcgggtcgcaaaggcggccagagccagggaaacacccaaggccaccagcgcgtcgagatggccttcccccgcgcccatgatcagggacaggggggaaagcacatacagggccagccaagccggcggcagccgacgcttggccaggaccacggccagggccagggcggccaggagatcggccagggcaaaggctgcccggaaagtcatgggggtgggcgagacggcggccacggcccggcagaacagctcggccaggggcggataggcggcggtcagctcggggtggttgacccggccaaggacggccacggcctgggcggacaacagcccaggcagcctcgggtcgccgggcgcgatcaaataagggttgcctccggccagctgcatgtcgccttcgacgatgtagcgaaagacgtcggtgtcgaccggccaggcccagacaaagagcagccgcgcgccaaggcccagggccagcacggcggcggtgacgcggccgcgatgccctccggtcggccagctacgcacggccaggaccagggtggcgaaagctgcggcaaaacaggcggcatacaagtagcgcccggcctccagacggccgcacagggccagggcgacaagagccgccaggcaaagcagtccgcgccagacgtggccaggcaggccggcaaacgcaccggccaaacacgccccgccggtccccactgcctgatgcacgcttggaagccttcgtgtcacggacgctccggcatagcggcaggcgcgctgcccgtgccgtcgccctggggcggctggcccaaaggctcgcctgatggcggtccatcaccgccgacaccaacaagcggcgcgtccgcgccgataagggccgaagtccatggcccgggcgcatcattgagggaccagtcatagtcgtcatacaccggccggcgctccgccagggcgtcaagcgccgcgcccagcgccggcccggcaaagcgtcgcacaaattcccactgccggtcccggccgccgaaatcctcggcataccagtcaaaaatgcggatcagacgcaaccggccgccgtccaccctcgctccggccgggtcgttcaggcaggctcgagtccgttcctccagcatggcgtccaggacctctccccggtagggaacggacagcagcggcggacaactcttggaggcgcagttgagcacgaagtgcagccgggggtccgggtattgccggcgcaggatgccgtgctcgatgtcgtccagggaaaaggtctgaccgcccaaacgcacaaaggaacgcttccagggcgaggccaggaagccgccggcctccttgatggaggatatccccggccaatggtccatgatgaggcggatggtccacaggttataggcgtttatatagagcgctacgcgatcaggccgggccagggcttcggggttttcggcggccatgagcgccaacgtcacgtcaagacgggccatgtccgccttgatgcccgcatagttcaccacgctcccgcgtacatgggcggccaaaaaatcaccgtattggtcaagatagtcaggagattgggcagctttggcaaagcctgcgaaaagcaacaacaaaatcgccagtaaaaccatcttggacacatcaacctcctcaacgctctgggataaaccccgcagtgacggttcagcgcaggagttggacatcaggcgcgatgagccgtggaaaaccaattgaattccttccggtattgttgcatattccttcggtcttcagttcgttggggggcataacgtcgtcgaacccgcgcaccggcaacccttgtgcaacaaccatgacgcaacccaggtcttccgacgcagccccgccccgacgcccaggcctgagcctgctcttcggcctttatgcactgactttttcccttttcctgccgccgccggcctacgccaattctcagccccgtttccagcggttgtccctggaacaagggctttcccaatcctatgtcgtctgcatggcccaggacaagctgggttttctgtggatcggcacctacgacggcctcaaccgctacgacgggaccaatgtcgtggtctaccgcaacatcccgggccggcccgactccctaccggataacagcatccgcacgcttttcgtcgatcccgtagacggcacgctgcttgtgggcaccaaaaacggcggtctggccgtctatgaccgcgaagccgaccgtttccgcccctaccctgtggcagccccctaccccagcggcgatgtggacaaggaaatccgggccatagccagggatgcggccggcaatctctgggtaggcggcgcagccggcctggcccgcatctcgccggccggtgccgtggacgccatggccttgtctgaccagaacggcagtaccgtcaaaaattcggttatcgccataaaagcccgggccgacggcagtctgctcgtagccaccaatcggggcgttcatgccgtgaatccagccgacggccaggccgcggccctgcttcccggccccctgggcgagcttccggccgacgcgcgcatcaacggcattgcctgcgacggcccggacacgctctgggtgctcacggaaatacacggcgcttatcggttcaatcaagccaccggccggtccgatcaccatctgcccggcctggccacctggtttgccttccgcgactcctggggcggccttttcatcggcaccaaccgaggactggcccgcatgtggccggacccggaccagccgggaaagttgatcccgtccatggccgtcaacaatcccctggacccggaaagcttgtcccaggacgaggtgttgtgcgccctggaggataccggcggcctgttgtggttcggcacctattccggcggcgtgagccgctacaatcccgcctatcaggcgttttccgtctaccgggccggaccgggactgcccaccgccctgtccggcagtgcggtcagcgccgtggcccaggaaagcgccgacatcgtctgggtcggtacccgctacaacggcctcaatcgcatcgaccgccgcactggcgaggtcacggctttccgccacgacccggccaacccggacagtctggccgacgacggcgtcaactgcctgctctttgaccgccagggtcggctctgggtcggggctaccgaccggggactggaccgctacgaccccgatagcggccgcttcgtccactaccgccacgacccccaaaaccctgagtccatcagccagaacaagatatggtggatcgccgaggatgaagacggcatcctgtggctgggctccagttcgggcggccttaaccgcttcgacccgacaacgggcaaggccaaggtctatcgcaacgatcccaataatccggccagcctcagccacaatcgtgtgcgtcacatcaccccggccccgggcggcatcctgtggatcggcaccaatgccggactcaaccgtttcgacaaaaacaccgaaaccttcacccattgggaacacgacccggacaacgccaattccctgtctaacaaccgcgtcacccccattcttcttgatccgtcaggggtcttgtggatcggcaccgatgcgggactcaaccgtttcgagccgcgcaccgggcgttttcagcgcgtcaccatggccaacggcctagccaacgacggcatccaggggatgctgcaggacaaggacggcaatttgtggtgcagtaccttccgggggcttttccgctacagcccgggcaacggcgaggtgcgcaactattcggatcgggatggtctggccggcctggaattctggatgaacgcctacgcccagggcaaaaatggcgaaatgttttttggcggcacaaacggcttaaccgcttttttccccagccgtatccgcccaaacccccacgccccgcccgtggtcctgaccgggcttgccgtgcgcaacaaaccctatggcgccaaccctgtcacggtaagaaatttagcccttggccacgaggacaacgtcgtggaactgtcctttgccgccctggatttcgccgatccgccccgaaacctcttctcccacaagctcgaaggctttgacccggaattctcccccccggcaggcaacaataccgtcacctacaccaatctttcccccggggaataccgcctgcgcgttcgggcctgcaataacgacggtgtctggaacgaaacagggctgacgctggccattgccgtggccccgcccttttggggcacctggtggtttcgcgccctggccggactggctgccctggccttgctccatggcggctacagactgcgggtttccgccctggagaagcgtcgccgggaacttgaggcaaccgtgcgtcgccgcaccgctgacctcgaaaacgaaatcgaggaccgcaaggccgccgaagatgccctgcaccgcagccgtctgagcttttccgccattttccaattctcgcccctggccgtcaccatcagcgaagagcagtccgccaggatgctgcgcgtcaacgaggcattcagccacctgaccggtatccaggccgagcaggccattggccgaacatctgaggagctgggcttctgggaacgcttcgaagatcgccaacagcttttgatcgaactgcaagtcgccgaatccgtcaccaaccgggaactggcctttcgtcatgccgatggccatcgcatcgtcggcctttgttcctgcacggtcatcgaggctttcgaacggcgctgcctgctcatgctcatcgtcgatattaccgaacgcaaggccctagaaagcgaactcctggccgcccgggaacgggccgagcaaggcagtcgggccaagtccgacttcctggccaacatgagccacgagatccgcacccccatgaacgccatcatgggcatggccgaccttttggctgacaccccgctcacgccccgccagaagcgctatgtggacatcttccagcactccggccaaatcctcatgcgcgtcatcaacgacatcctcgacctgtccaagcttgaagccggcaagctgaccctggagcccgagcctttcgacctgcccgaagccctgttccagacctgcgccgtgttcacgccccaggccgaggaaaaaggcctcccgctgttctgcgatcttgatccaggcttgcctcgccgtgtttacggcgaccccatccgcctcacccagatcgtggccaatctgttggccaacgcctgcaagttcacccacgagggcgagatccggctgtcggcctcggccacgcttcttggcccttccgccttccttttgcgcctgacctgccgggacaccggtgtcggcatcgcccctgatgacattgcccgggtctgcgacaattttttccaggtgggcggcaatcaacgccggggaacaggcttggggctggccatctccaagcgcctgacggaactgatgcagggggaattatccatccaaagcatccttggccaaggagccaccatcacggccacggtcaggctggagatcgccgccgaatccgcttcaggagagcaaacgccggaatcctccttggtcgcggagcttgcggacgccggcggccagccctggcgggtgctgttggccgacgactctgtgggcaaccgtcaggtcgtcagcctgttcctggaaaatcagccggttatcttggaagaagtggagaacggccaggatgccctggaccggttcaagaaaggcggcatcgacatcgtgctcatggaccatgtcatgccgatcatggacgggctgaccgccgtgcgggccatgcgtgaacatgaatggatgtccggccttagatccacgcccatcatcggcatcaccgcccgggcttttccagaggacgaggctgcctgcctggaggccggttgttctgcctacctgagcaagcccgttcgccgcagcgccctgctcgccgccatgcaggggctccttggccgccgggacgactgatcaccgcccaaaccagagacttgcccacgccagaacggttactgcccgagccggaagctgatgacggcgcgctgatcgtcgataaaggcgtacagcaggctttggacgtccgcgtactcctttgccgtatacgccgtcttgttgataaccaactcccgcttgactgtgagctttccgtcaataacctcgtagctggcggtaaagcgccctgccggactgttcaggtccacggccgccggcagatgttcgaccgcagctttcaaaggtaaggcgatgaccgaacgccaggagtattgcctggcccctacgatgaccggatagtggcgcggtgtgcctgtggtgagataggcgcgcagattgttcgccggcgcgacgtcgaggccaaggggcacggtcatgtacaccaagggggaagactggaccacgccgtgggggctcgttcactggccctcgatttccaaatgtttggtcagatcgcgcgggttcgtcgagcgaatttctccatagccgccttccggagtggcctggagcagctgattggccaaggcggccagggaactcgccccggccaggacgcggcggacagcgccgtccgcgccgggggaaagggtcatgcggaccttcccgtgcaccgtcccgtcggcatccacggacaactcggcgttatactggtaggtattggaggccggggtctgggccggagtttggcgcttctccccgtcgccgctggcgatgaccgtcagtttgtcggccaggccgttgtcgaggacgccaaaaaccgcgaacggatcggtgggattggcgtaggtgtcgaagtccggcaaataagccagcacatgattgaacgacgccgaagaccacagcggcaacggttccatgcttatgccccagttcacaagggccggcagcacgcggatgcccagcgtccccagcaaggcctgcatgagcacgacatggtctttgcagtcgccgtagccgttgcgcaagacggttgccgcctcatggggcacgacattgtcgctttcattgagaaaaacggccacgtagcggatatgggccgccacccagtcatggacggcccgggccgcgtcaagccccttggcgtcgccgacgatgtttcgtgccaaggctgcgatttccggcgtcggcgcagccttgccggcgctgcgggccgcatagacggctcccaaggcctcgtagccggccagggtggtggcgacaaagaccggcccgacgtccatcggggaaaccatggacgcctcggccggtgacaaggcgccgacgtcgatggcggcggtcagcacccggttgctgccagcctgggcgtcatcgaccgcgaaaccaccgcgctggccccactgcagcggcacggacgacggagcctcgatgcgcgtctcctggcgcatgtggcccccaaggcccagggcaaaaacaacattgaagccgaagacggcgggtttgctgacgacatgccgccaggtgcagtgcacgacgctgccgaggcgcagctggggaaattcgatggtcgtcgtctgggaggccacgaaccccggcgtgttccgggcggcggcgctggggcgggtgaaaatgttctccgccggcacgtcgaggcgctgtccgtccggctggagcacccaggcttcgagcacctccagggtcgcggcggcagggtcgaaggtgaaagccgccgtgctgttggctgccagcaaatgttcatcggcaagaacaagttccgaggtttgcgtctcgacgtaggtcaggtcggccgccacgagatagtcattgcgctgcagacgatggactccctccggcaaggcggccagggcattgcccgcgaaaagcgcccagacggcaacgccccaaagggcaacttgtaaactacaaacgtttcccaaaaattttgggcacttcacagccatacgtcttccttggccagcccggtgcatcacgtccgggccgaaagggaaccaccgccttattccagttcccggcacacggcttcgccaaggccgccaggccgcatgggccgccaccccgaagcgggcgacagggtgcggtccaggaacttgccgtccaccccgacccaagccgcctgctgccggatgatccgcccctgaccgcagtccagggtcacccgttccagggcataggccacgccggtgggaaagcccatctcatgggcgatctccagcccctcggcctcgtcgaacacccgctttacccgaagccgcagcacctcacccgagacgcgcaccgaatgccggtcatagtagagttccaccgacctgtcgtcatgggcggccagaaaacgccagtccgtggcctgggccggtgggcagacggccagaatataaaccagggccgtaagcagcaacatcaggcgcatcgcacacctcccggagacggaaaacaacggtttcaggctattagcattcttatagccagccctcaagccggcagtcgcccagcatcccgccacatcccacatccctttgacgcaggggcaaaagggccttatgactcccccggggagtcggacaggctgtcgtcgcgggccgcaagacccggggaggaaagtccgggctccacagggcaggacgctggataacgtccagcgggagcgatcccgggagagcgccacagaaaacaaaccgccggcgcctgcgccggtaagggtgaaacggtggggtaagagcccaccagttgccgcggcgacgcggcaagctcggcatgccccgttcggagcaagaccaaataggaaggcgttaaggctggcccggccgtgccttcgggtaggttgcttgaggccgcgagcaatcgcggtcctagaggaatgatggccgccccggtttatccggggaacaaaacccggcttatcggccgactcccccttttttatcacgctttagcgcaaaggattccccgtgtccctgtggaccgtgctgctcgccgccggctccggaacccgtctggcccaggcctcgggcggcgtcaaaaaacagtttctctccgtcggcggccgcccgctctactggaaagccctgaccgcctttgccaagtccccggacgtggccggcgtggtcgtggtttttgcgcccgaagacctggccgaggccacccgtgagctggccggcttcctggatgccaatcacccgggcctgccggtcctgaccgccgccggcggagccagacgccaggattccgtcaaaaacggcctcgacgccctgccccgcgaagcgcgtctggtgctgatccacgacgcggcccggccctttgtcgatgccgggctcatcgcccgggtggccgacgccctggccgccggacgcaaggccgtcatcccgaccctgcccgtcaccgacaccgtcaagcaggtggacggcgacagggtgaccgccaccctgccccgccatgagctggccgccgtgcaaacgccccagggcttcgacctgaccctgctgcggcaagcctatgcccacgccagaccggatttcgacgtcaccgacgacgccagcctggtcgaacactacggccagcccgttttcaccgtgcccggagcgccgcgcaacatgaaaatcacccatcccgaggatctggccagcctggccgaggccgccgcgccgcccgtgcccgtcaccggctacggctacgacgtccaccgctacgccgatccgcgcaaccccggcaaacagcccccgcgccccatgaagctcggcggcttccccatcctcggcgcgcccgaggtgctggcccactccgacggcgacgtgctgctccatgccctgaccgacgcggtgctgggctgcgtggccggcggcgacatcggccggctcttcccggacagcaacccggatttcgacaacatggcctcgggcgtgttcttgagcgaagccctgctggccgccaaggccaagggcctgaccatcacccacgtggacctgaccatcatcgcccaaattcccaagatcagcccccacgccgaggccatccgcctcaacgtggccgcgcttttggggctcaataaagagcaagtgaacctcaaggccaccaccgaggaaggcctgggctttaccggcgagaaaaaaggcatcaaagccgtcgccctggtctccggctggcgacgcccgtaaggtgctgggctctgcccagacccggccgggcgctgcccggcgcccgccggggggcttagccccccggacccccaacctgggttgcccatgagcgcaacaacgtaaccgggcggctggctataataacgttaaagctaaacttgaactatcgcaccccacccccttaaaaagtttttggggaaggagggggtccagggggaggaaaccccttttttcaaaaaggggtttcctccccctggttgactttggcccttggctttgcaaagggtgggaacttttcgacgggaggcgaggatgcagctgtacaataccatgacccggaccaaggagccgttcgtttcccgcgtgccggggaaggtggccatgtacgtgtgcgggatcaccgcttacgacctgtgccacatcggccacgcccgctcgtcggtggttttcgacgtgctcgtgcgctatctgcgccatatcggctttgacgtgacgttcgtgcgcaacttcaccgacgttgacgacaagatcatcaagaaggccaacgccgaggggacgacctcccaggaaatcgccgagcggtatatcgcgaccttctatgaagacatggacaagctcggaatactgcgccccaacgccgagcccaaggccacggaatacatcggcgaaatggcttccctggcccagcggcttatcgacagcggccacgcctaccgcacgccgtcgggcgacgtgtatttccgggtgcgttcctttgccggctacggcaagctttccggccgcgacgtggaagacatgcgttccggcgcgcgggtggccccgggcgaggaaaaggaagatccgctggattttgccctgtggaaggcctccaagcccggcgagccggtctgggaaagcccctttggcccgggacgtcccggctggcacctggagtgctcggccatgagcgaaaagcttcttgggatgcccatcgacatccacggcggcggccaggatctcattttcccccaccacgaaaacgagatcgcccagagcgaggcggccatcggcggggaattttgccgttactgggtccataacggcttcgtgcgcatcaacaccgagaagatgtccaagtcccttggcaacttcatcaccattcgcgacatctacgcccgctacctgcccgaagtgctgcggtttttccttctctcctcgcagtatagaagcccgctcgactattccgaccagggcctggacgaggcagaaaaaggcatcaagcgcatctacgccgccaaggtgcaaatggagcaggcgcttggccgcgccaagtggagcgagaccaagctgccggccgacgtgacggaagagctgtcgcgccacgaggaaggcttcaccgccgccatggacgacgacctcaacaccgcccaggccatgggccacgtgttcggcctggtgcgcctggccggccggctcatggaagacaagaccctggccaagagccgcgagacggccgaggtcctgggccgcatcctggccgatttcggcgtctgggccgaggtgcttggcgtgttcggcacggacgcgacggccttcctggccgatctcaaggcctgtcgcctcacgcgcctgggcatcgacgccgcccgggtggatggtctggtggccgagcgccaggacgcccgcaaggccaaggacttcgcccgctccgacgccatccgcgacgagctggccagccttggcgtcacggtcatggacacgccgaccggcccgcaatgggacatcgcctagccaaagacatgccgcgcatcgtctacatccaccacaattgcttcgtgctggaggcgggggaacgaacgctgctgttcgactaccccgccccggcctatctgcccgaggcggcggcccggatctgcgcatcgcatctggccgggcggcagctgactgtctttgcctcccacagccatgacgaccacttcgatccggagatcgtcgccgcgaccagcggcgcggccgcccggcagttcgtggtgtccgacgatgtggccgacctctacggcgacgccctgccgccgggccgtatcaccatggaacccgaggatcgggtggacctagacggcctgaccgtgaccgccctggaaagcaacgatatggggctggcctatctgctcgaaatggacgggctgacggtctattacggcggcgacatggccctgtgggactggccgggcaactcgcccgccgccaaccgggccgtgggcatgacctggcggcggcaactgggtcgccttgaaggcaagcgcctggacgtggcctattccaataccgacccaaggctgccggaaagcctgtgcggcgcgccggaactgcttgaccgggtgcgcccccgagtttttgtccccatgcacctcggcggccatgtccactacctggacaccttcgccccccgcctgacgcgccccggcacgacgcttttccgctacgccaagaccggcgatattttagatatttgaggcgaatttaaagctggatgtgaagaagaagagcctccggcggccgggggcctgaggcccccggacccccaaatgggatgtcgagggccggggggcagattcccggcctccgccgcctcgtcctagcctaccgacagtcaagctccaggcccacggggcagtggtcggaccccatcacggccgcgtcgatccaggcccgcttgaccttgggccgcagttcctcggacacgaagaaatagtcgatgcgccagcccacgttgcggtcccgggccttgaaccggtagtcccaccaggaatagtgcccgccttcggtcgtgaacagccggaaggtgtcgacgtagccggcggcgacgaagcggtcgagccaggcgcgttcctcgggcagaaagccggaggtcttttcgttggccttggcgtttttgaggtccagggcggtgtgggcggtgttgaaatcgccgcagaccacgatgggcttgtgcttgcggagttcttcggcatgggccaggaaggcgtcgtagtaaccgagtttgtaggccagccgctccggcccccggccgccattggggaaatagatgttgaagaaatggaattcctcgtattcgaggtggagtagccgcccttcaccggcaaaagcgggatcgggcagttccatggcgatggacaacggctcggcccggtagaagcagccgaccccggaatagccttttttcaccgtggaactgcaccagacggtcttgtactggtcggtgtggccgaaatccgcttcatggccggtctggattttggactcctggatgccgaccacgtccgcaccgctgccggccagccagtcccaaaagcccttctgcaccacggcccgcaggccattgacgttccaactcaccagtatcatacgaatcctttagtcgtctccgccgactagtcccctggacaacgccatggggccagcctgtggcatcaagcgggttcctcggccaagtcttcacgaggggcggccgcttctccgtcgagcatggttagaaacgcctcggcacagatcgggcaaaactgccggccagcctcctcgcggatgatgtccagcgcctgggataacggcatccccttgcggtagggccggtcggtggtcatggcgtcaaaggcgtcggcaatggcgatgatgcgcgctcccagcggaatatcctcgccgctgatggccgtgggatagcccctgccgtcccagcgttcgtgatggagcaggatcaggggcagcaccggggccagggaggcgatgggccgcaggatctcggccccgatgacggcgtgctcctggatgatggcgtattcctcgggagtcagccggccgggcttgaggagcacggcgtcgcgtacgccgatcttgccgatgtcgtggagattggagccgatttccaggttacgcaactcgcgttcgccaaggcccatggcccggcccaggcgcatggccatgcgcgacacccgggcggtgtggcccttggtgtattcgtcccgggcttccagggcagtaatgagcgctgacatgctggacaggacgtgctcgtgctcttttttcaggtggcggtagctttcgccaaggagctgctccaccaccagatgcatcttttccacgtcaaagggtttgacgaaatagcgtgacacgccaagccgctcgccacgtttgatgtcgctggcatggccccgggcgctcatgatgacgaccagggtgttgcgcagctcaggctgcttgcggatgtgttcgcacaactcgtagccgtccatctcgggcatttcgatgtcggtgaccaccacgtcgggctgctcggccagggcgagttccagggccttggccccgttttcggcggtcaggacgcagtggccgtttttcacgaaattgtggcgcagcatttcccggatgagcttgctgtcgtccacgaccagaattttattgtggcgcttacgttcggcgatgtcgaggtgttccgagacttttttggaaagcatctcggcggtgaacgacttgagcagataatcatcagccccgtagttgaaggccgtgtccatgtccagggcattgtcgctgctggaaagcatgatgaccgggaggtacggtccggcgttgtcttccttgagcttgcggcacagctccaggccggacatgccgggcaagagcacgctggtcagcaccagctcgaaggcgtggcggcggcacaacgccaaggcgtcctcggcgtttcgggccgaaaccacccgaaagccgctgctggccagggcggcgcgcaccacatggagcagggtgcggccggcgtcgacaaacaggatttcgcgcggcccggcaacgggttggcgggcctgggaggcggccttgagttcggccagcacgccggccagggtcaggcgattgaccggcatcacctctgggccaaggatctggcaggcttggtgttcctgatgctgcccttcctcgaagggacgcaggcacaggatgggcagctcccgacccgctttccggcccgcctcgcggatggtcccgagcaggtcgcggcagtcgcagccggcataggaatcctgcaccagcacggcattcgccggcgggtcgagagcggccagttcctgggcggcgtccggactcaaaaaacggtaatcgactccggccgtcaggtagatcttgctcaggaaggcccggtagaacaggatgtcgatgatattgacgatcagcatcgaagctccgggcggttccagatggcggcgcttgccggtcctcgcgtggccggacaggaccggttgtcgtagtcgtcggggctggccaggggccatgcctaacggtcaaacctgacacaatcgagcggtcaacccctgggcgttgcgttcgatacgggcatatcccccgccggccagagcgccggggttgatgaccacagtacgtccgatggcatcgacagcgacggactcgtggatgtgaccggtaaggcacacggccggctgggtgcgttcgataaactcccgcacagcccggctgccgacatggactccgcccccgacctggtccgtggccgtaccgtagggtggcgtgtggcagacgaggacgaggtcggggcaatgggccacggtctgccaggcggcttcgagccaggcggcgatacggtcctcgccggcttcgctgggggtgccgaacggagtcggcgtggaccagccgcagccgaaaaaccctacgccctgggccgtgacccggccggtggcgtggaggtttatcccctcgcccgaaagataagcgtccacctcggccagatccatgttgccgatctgagccatgagcaccgggttgacctcgcgcagggccgcgatgacccgtcgggcggcggaggccccgcccttgatggtcaaatcgccgctaacgaccaggccggcggcggcggccagattgggaattcgcccgagcatggacacgtcgtcatggatgtcgcccatgccgatccagaaagcgtctgcgctcaccctgtcctccctggttacgcgcccttcccctgacggggttcgcctgttactatgaaacggttgtgaaaacattgcaaccagatcagccgaccgataccggcaaagccctggccaagaacgccctgcgccgcgacatgtcggcccggcgggccgccctgacgccggaagccgttgccgccgccggcttgctggccgccaagcgcgtcctggccctgcccgcctatgtccaggcccgggaaatcctggcctacatggccgtgcgcaacgaacttgacgccgggctgatcgccagccaggccctggccgacggcaaacggctgctcttgccgcgctgccgcgatggcgcgccgggactggtcgacctgggctgcgtgcgttgcctgtccgaggccgcccctgggagctacggcatcccggagccgccgcgcgaggcctgcctgcctccggaggccttctcgccggacctgatcctggtcccgggcctggcttttgaccggcgtggcaacaggcttggtttcggcggcggctactacgaccgtctgctcgccctgcccatggcccaaaacgcgttcaccgtaggcctgggctacgatttccagcttatcgccctgctcccggccgaaccctgggacaaacctgtcaacgccgtggtcaccgaccggcaaaccctcctgacaacaccatgaattacatccccttcgccttcccggatatccccaacgtggcctgcgcctttggcacggggccacgcaccatggcctttaccggcgcggccgatcccggggacgtcatcgccgtccggcaaagcctcaaggcatccttgggcttcgccgcctggcacagcctgcggcaggtgcatggcgtggacatgattttcgaaccggaattcgaaaccctggaccgtccgagcatcgaggccggcgacggcatgaccgaaacccggcccggccacgccctggccatcaagaccgccgattgccagccggtgctcatcgcccatgcctcggggcgctacgtcatggccttgcacgtgggctggcggggcaatgtccaggatttttgcgcccgggcggtgcgctcgttttgcgtgcgctacggcctgtcgccggccgagttgtcggccgtgcgggggccgagcctggggccaggcgtctcggaattcacggcttttgcgggcgaattcggcgaggccttccggccctggtacgactaccgcacccgccgggtcgatctgtggcggctcacccgcgaccagctggtcaaggctggcctggacagtgagcgcatcttttccctggacctgtgcaccctgtccctgccgctgttcttttcctaccgccgcgacaaatcgaccggccgccaagccagcctcatctggatcaaggaagattgacaaccagccgacgccgcgctggcctcgccttcccgtcaaggggtccggggggatcatccccccggccgccggaggcgattcccttcccttctcgactacaatcgatagccgtcttggagaaaaagctccaggcaggcgtcgaccacgtcggcgtcgtaccggctgccgcgaccagaacgcagctcgtccagggcgacttcccgggccagggcagcccggtaggggcgatgggagttcatggcttccacgacgtcggccacggccaaaagccgggaaccgagcagggtgtcccggccggaaaggcccttgggatagcccgagccgtccagacgttcgtggtgctccagcaccatgcgggccacgggccaggggaagggaatgtccttgaggatttcgtggcccacggcgctgtggtcgcgcacgatgcccatctccatggcgtttagggcctcgggcttggccaggatctcggagggcacgtggatcttgccgatgtcgtggaccagcccggccacgcgaatcccctcgcgttcgtcctcgccaagccccagccgggcggccagggccacggccaaggcggccacgcgctgctgatggccggcggtgaaggggtcgcgcttttccgaggtgacggtgagcgcgttaacggtctcggccagggtcaggcgcagattgtccacggaatcgcgcaatgcccgctccacctcgcggcgatgggtcatgtcgcggaaaaccagcaccgagccgatggactggccccggccgtcgaggatgggcgacacagtctgctccacgggcacgtcgcggccgtcggtcctgtggagggtggcggcttcccgcccgtttgggccgtcggcctcgtccatggtggcctggtagacttcggccagggggcggccggccagctcggccgcccccacgcccagaagcgtctcggcggccggattggcaaaaaccacccgcccagtttcgtctgtggtgagcaggccctcgcccagacagcgcagggtcacggcggtgagacgctcggagcgggccaggcgcttttccatacgcgacttgtacagggcgatctctagggcgctttgcagctcccgttcctcgaagggcttgatgagatagccgtagggaccggccgcgccggcccgacgcagggtggcccggtcggagtgagcggtcaaaaagaccacgggaacgccgtagcggtcgcggatggcggcggcggcgtcgatgccgtccatttgcccggccagcatgatgtccatgagcaccagatccggggccagttcgccggccaggcgcacggcctcctcgccggtatcggcctgtccggccacgacgtagccgaggcggcgcagccgatggcagacgtcgatggccaccacggcctcgtcctcgatgacgagcacccgggccggcacggcgttttcgctagccagatcatgcatggacagggtccgatccgcccaggatgtcgtccagggcggcggtcagggttggaaaacgaaaggcaaaccccaggcgcgtgagccgctccggcactgcccggacgccgtttaaaaagagttcctgggccatttccccgagcgtaagccgcagcgccattgccggcgtgcgcagccaggccggccgggaaagcgcccggccgatggcccgggacaattcgttttgggtcacggctccgggcgcggccagattatacggtccttgggcttcgggggattccagcaaaaaccggatggcccgcacctcgtcggtgagatgaatccagggaaaccactggttgccggcccccagcggcccgccgacgaaaaaccggtacggcgcaagcatgcgaggcaaagccccgccgctgccgtcgagcaccacggccgttcgggccacgacccggcgcacccccaaagcctcggccccggctgtggaagcttcccatttctcggccacttcggccaggaaaccccgtccaaccggagcgtcctcggcggcgggggcgtccccccggtcgccgtagtagcccgtggccgagccttggacgagcacggccggccgggaagccaccgaggtcagggcgtccatgacggcccggccggcggccaggcggctgtccaggatgcggcccttgcgcgccgccgtccaatagcccgaggcgatgttctcgccggccagattgaccagggcgtcggccccgtcaaggctctcccgccagcccgtgccgcttcggccgtcaaaagaggcgaaggaaacgccgccaacggccgcccggggcgcgccgcgcgaaacaatgacgacctcgtgcccgtccccggtcagggaaagggtcagggtccgaccgataaaccccgaaccgcccaggatgaccacgcgcatgatgccctccttgctccgccaaacggctggcttcaatatacgggatcccgggaggatggcaactcgcgcacggactcagtaggtgaaatcgagctggtaggaaacgggccgggcggcgtcgaaggaccagaaaaaaaggccgtttttgagccacggcgacacgtctggccgggtcagggacagttccagggacaggacgtaggtcacgccgcgctccaaccggtcccaggggccgagatcaatgaggatttcaccgagatgcttgcgaaaaagcgaaccgaggtccttgtcggcggccgatccctggcccggcagggaaccgacatattcgccggtcttgatgcgccgcagttccccttcccaggcagcggcgctgacgctctggttccagacgtaatcccgtttgagggagagtctggctcgacaacgcaggttcaggcgctcgccgacgtccaggacctggacgatgcgatctagcccggtgggttcgatgccgaagcgcacccggatgcggccctcgtagttgttgagcacgaggttggtcaaaagcagttcctgggccgaagccggcgcataggcgccgcaacacaagaccccggccagagcccagaccaggcaggcggcaaaccgccgacgtgtcatcgtcccaaggcgcataaacgacatgccgctccaacgtggggcgaaagacgcgaccccaccgatcatgccctaaaccaaggcggccgctttgacaacaacgcccccctcggctaccaccccggcaggtccgccgcagcggccgccaaacctatgaaaccccttcgactcatcgccgtcggccaggtccgaaccccgtacttccgcgaagcctgcgcccattacctgacggccgttcgacgctacctgccggccgaggagattctcgcccgggacggcaaatcggccgatccggcccggcgcaaggccgaggaggccaaggccgtgctggcggccctggccccgcgcgacttcgtggtggtcctggacgagcacggcccgtccctgccctcgaccgaactggccgcgctgctcaaaaagcgcatcgaagatccgggccgcgctcccgcctttgttatcggcggcccctttggcctggacaaagccgtcctcgaccgggccgaccgcctcctggccctggggccgggcaccctgccccacgaattggcccgggtggtgctctacgaacagctctaccgcgctgcctccatcaacgccggcgcgccctatcaccactaacgcacaaggatcaccgcccatggccctgccgctcatcaacgccgcctatctggaaaagctgcgcgaatatttcgtctccggcgacatcgttttcgacttcgaaaacgcctccgaagccgacaagggcgaaatcctcgatttcctggagacgctcatggacctggccgaagccgccgacgccacggccacccggcttattttcaaggacgcctatctggcctcggcccagggcgagaacagcgaaatgtaacgcgtcttgtcgccaatccggtagtcgccggccgcgctcagggcaaagcccggcgggatttcgtcgccttgcggcggcgtgcccgtcatggtcagcacggccatgggccgaggcacgagttcccggcagatggccaaaaactgcggccaaggcgcgaaggcgcggctcaggcacaggatgaacgcgccgggatgggccgccacaatgggcggtaccgtggcctccacccgaccctcggcggcaaaaaggccggcaaaacccaggcgcgcggcgcattcgccaagaaagaccgcccgtttttgccgggcttcgagcagatggtagtcgccccggttccaaaaggcccgcagcggcacgccgggcagcccggccccggccccgaaatccagggacacgacagactcgccggccggcggcaaaaacgccgcgcccgggccggacaggaaatcagccacatgccaggaatcggcgatgagcgtttccagtatctcgcgccagtccgatggtccgaccagattgacccggccgcgccagcgggtcaaaagcgtcagatagccggccagtttttcggcttgttcaggcatcagcccgcgccccaggctcgccgccgcctgggccacgccggcggtgtccagccccgattgtccttgctccacgggttcctccacgtcaaaattgaccgttgcacatttaggcccgttgctctaccaatcgcggccgaaacgatgcgaaaagctcttaaggagaggcgaacgtgagcgcaaccgaaaaccgcctggccgtgctgttccccggccagggttcccaggaaaaaggcatgggccgcgaactggccgaggcttcggccgaggcggcgcagctgtggttgatggcggaaaaggcctcgggcctccccctgcgtgaaatctactgggagggcgacgaagcggccatggccgatacccgctctctccagcccgccatgaccgccgtgaccctgggcctgtggtttcatctcaagtcgaaactgaccccgctggtcgggtttgtcgggcacagccttggcgaatacgccgccctggccgcctcgggcatggtcgagattccggccgtgttcgaactgaccagccttcgcggccggctcatggccgaagccgcaggcggcgacggccggatggccgccgtgctcaagctctctcttgacgacatcgaggacgtggtgcgccaggcgggcgagtcgaccggcaagatccttttggtcgccaactacaactccccggggcagtacgtcatttccggcgaagccgcggctgtggaggccgccgccgccctggtcaaggacaagaagggccgggctgtgcccctggccgtcagcggcgcgtttcacagcccgctcatggccgagccggccgccgaactggaaaaggccctgcgccgggccgggctgcgcgccccgtcggtcgctccggtcttccacaacgtcaccggccgccccgagcccgacgcagccaaggcgcttgacctcatgtgccgccagatgacctcgcaggtgcgctggatcgacactctggccgccctgtggcaggccggcgcgcgcacctttgtggagcttggccccaagggcgtgctgaccaagctcctttccgccaacctcaaggaatgcggcgaaccttatacgggcgtttccgtggccaaacctgccgacgccgccgctttggaggcctgattccatgcgcgccaccgccattttgcgcgatcttctggccagcgccctggaaaaccagggcattgcctggccggtcaagaccaccattgagccgccccgggacaaggcccacggcgatctggccaccaacgtggccatgatggcctccaaggcggccaagaagccgccccgggaactggccgagtccctgcgccaggccctggccgccgatccccggctggcctcggtggaggtcgccggcccgggctttctcaatgtcgccttcacgccggccttctggcaggagacggtttgcgacgtggccaaggccggcgacggctacggcctgctcgacatcggccagggcgtgaaaatacaggtggagtttgtctcggccaaccccaccgggccgctgcatatcggccacggacgcggcgcggccgtgggcgacagcctggcccgggtgcttcgggccgccggcttcaccgtggagaccgaatactacatcaacgatgccggccgccagatgcgcatcctgggcatgtccatcctctatcgctacaaggagctcatcggcgagcccgtgaccgagcccgaggactactaccggggcgagtacgtcattcccctggcccaggatatgatcgacgcccacggccgcaagctgctggagatgcccgaggccgaagccaccgacatctgccggctgcacggcgaacgcgagatcctggccggcatcaaaaaggacctggaagacttccgggtccaccacgacgtctggttcccggaatcgaccctgctcgcggccggggccgtggacgccgccttcaatgaactacgcgacaaaaaactggcctacgaccaggacggggccttctggttcgcctccaccgcctttggcgacgacaaggaccgggtgctggtcaagtccggcggcgaactgacctacttcgcctcggacatcgcctaccacgccgacaagttccgccggggcttcgacgtggtggtggacatctggggcgccgaccaccacggctacgtgccgcgcatgaaggcctgcgtttcggctcttgggcgcgaccccgaggccagcctcaaggtcattttggtgcagcttgtcaacctgctcaagggcggtgagcagatcgccatgtccacccgggccggcaagttcgaaaccctggccgatgtggtcaaggaagtcggggccgactccgcccgcttcatgttcctgtcacgcaaatccgacagccacctggactttgacctcgacgcggtcaaggagaagtccatggacaacccggtctactacgtccagtacgcccacgcccgggtgcgctcgctttttgccaaggcccaggagcgcggtcaggccgtggccgagacctcgccggaactcctggccttactcaccaccgacgaggacctggagctgcttaagctgctggagcaatatcccgacaccgtggccgccgccgcccggactttttcgccccatctggtaagcttttacctgcgcgatctggccggacgcctgcaccgctactacaccgtcaacccggtcctgaccgccgggagcgacgacctggcctcggcccggctgcggctcctcgacgccgtggcccagacgatcaaaaacggcctggacctgcttggcgtcagtgcgccagacaagatgtaaccgacttgacattgcctcgtgatcggccattgtcgacagacgaggaaccttgcccatgaagcttttaagccgcctaaacgccacccgcgaaaacggggggccgcgaaaattcacctttgagatcagcatgtccggcgtggtttccgtcggcatcgtggtcgtgcttggcatgtgctgggtgtttattctcggcattctggtcggccggggctacaagcccgagacggccgtgccccagatcgcccagatgatgccgaccaccgaagccaagctgcccgacggcgaagccaaggccccgccttcggtgctcaagcccgaggatctccagttcatggaggatgtccacaaccagccaggagccgacgccgccgacgccgcgccgaccaagactccggccgatcccaagaaacaggccgcagccgccaagccccacgaccagaccgaagtgcgtcccgtgggcggcgctgccgccgcagctacgccccgtacgatcacgtcgccggctgcttcggccgcgccccgggcggtggccgtcgttcccccgccggccaagccggccgacacgcccaaggtcgatcccaaatcgaccttcgacaaaaaggccgggatgcgctataccgccacctatcaggtggcctcgttcccgggcaaagcccaggccgaaacccacgtcaaggatctggcgaaaaagggcgtgaccgcttcggtgcgcgaggccaagtccggcaataacgtggtatttcgggtcactatccaggtgaaggggtcggatgcggaaatatccgactccctcaagaagagcggcgaaaaaggcgctatacttctcggcaaaaaacccttatgaggattccccgctttcgcggcaaatcagagtgtaaagaggactgcccatgcttccaggctcttccgttcccaccaaggcgtttttcaccaagggcgtcggccgccacaagaacaagctgcagtcgttcgagctggcgcttcgcgaggctggcatcgaaaagctgaacttggtttacgtgtcgagcatttatccgccccattgccagcttctgacccccgaagagggcgtgaagctccttaaccccgggcagatcaccttctgcgtcatggccagaaacgccaccgacgaaaagaaccgcctggtcggctccgccgtgggcatggccttcccggccgacaagtcgaactacggctacatctccgagcacaccggctttggcgcggaagagcaggagataggcgatttcgccgaggatttggcctccaccatgctggccaccaccctgggcatcgacttcgaccccgagaccgcctacgacgagcgccgcgagacctatctcatgagcggcaagatcatcgactcggcttccatgccctgcgtcaccactggtgaaacgggcatgtggaccacgaccatctcggcggtggttttcatcccctaagccctcatgggacttttcggggcaaccctcgcctgcctgccggccgcgtccatccggggctcccgatgatggacgcggctttgcgtgctgcggtcatccatgaccgcctgcgcccgctttatcccgaccccaagccggccctggatcaccaaaacgcctacgagctgttggtggccacggtgctggccgcccagtgcaccgacgcccgggtcaacaccgtcacgccggaattctttcgccgctggcccgaccccgccgccctggccaaggccaacatcggcgaggtcgaagccgtggtccatcccaccggttttttccggcaaaagaccaaaaacctcgtgaccacgggcaagattctggtcgagcgccacaacggccggataccggccaccatggccgagctgaccgctttgcccggcgtggcccgcaagaccgccaacatcgtcctgtccaacgccctgggcatcaacgtcggcatcgccgtggacacccacgtgcgccgcctgtcctttcgcctgggcttgacgacgtcggaaaacccggtcatcattgaaaaagatttaatgcccctgtttgcccccgaggtttacggcgagatcaaccacctcctcgtcctttttggacgcgaggtgtgcaaggctcgccggccccagtgcggcgactgcgtgctcaacgacgtctgccccaaacacggggtgtgacgtctttacgccatgcccgccggggcgccggcccgccggtcccgcagcggcgcgctcccgaggtcagccatgccggccactgccgcctccccccatgccacccgcgccgaccgactggtcctcgccgccgtctttctcgtttccggcgcgtcggcgctgctgtttgaaacgctctggctccacctggccgggctgacctttggcgtcagcgtctatgccagcgcgctcgtcctttcgagtttcatgggcggactggccctgggcaatgggctgatttcccgctttggccgcgacatcaccgatccggtgcggttctacgccgccatggaagtcctggtcggcctgtgggggttgatgctcgtcctgggctttccctggctgacggtctggctcggggcagtgctccatcctgccttggacaagccgatgcttcttaataccctgcgcttttccttctcgtttttgctcttcctgctgccggccacggccatgggcgccaccctgccgcttctggtcaaggccctggcccgtcggcccggcgaatttggcaaggccctgggccgactgtacggcatcaacaccctgggggcctgcctgggggcgctgctcggtgagatggtcctcatcgcccctctgggcctttccggcacggggctggtggcctgcggcttaaacctcctggccgccgggggagccttggccatcgcccggcgtttccgggacgagccggtccgggatgacgaggcggccaagactgctcccgtgcgcctaagccctcgggccaagcggctgctggcggccggcttttgctgcggcgcggcctttttggccctggaagtcgtctggatgcgctttttgcagctctttgtgcgctccacgagcctggcctttgccgtcatgctggccgtgatcctggccggcatcggccttggcggcatgttcgccggctggtggctacggcgcgaagccgacggtcggcgcatcgccgcgcccctggccctgcttacggccgctgccgccctggcctcgtttcggctttttgaagccgcctcgggcgtcaccatcgaaggctaccagtccctggactggcgctatgtggccgtgctgtcggtcaccctcatgttcccgtcagcctttctctcgggcatccttttcacggccctgggcgaggccttccaccgcgaggtcggcgaccgggcgcgctcggccggcctcattgccatggccaataccctcggggccatggccggcccgcttctcggcggctttgtcctcatcccggccctgggcatggaaaaggccctgtttgccctgtgcgccctgtatctcgcgccggccctgctgtgcgccggcggcagcgcgccctggccgtcctttcgtaccggccgcttcctgcagatcgcaaccgccgcctttaccctgttcctggccgcctttcccttcggcgtcatgcgccagtacctgaacaaggcctgcgtcgatttcctcaaggacggcgaaatcctggtgcgcaccgtggaaggcgtcaccggcacgcttcaatacctgcgcaaggactacctcggccagccgctctactaccgcctcgtcaccgacggttactccatgtcttccaccgaccggggcgcgcggcgctacatgaagctgttcgcctacttcccccaggccgtgctgcccaatcccaagtccgccctgctcatctgcttcggcaccggctccacggcctcggccctggtcgagaacaagggcctggaacgcatcgacgtggtggacatctcccgtgacgtcctggccggcagccaggtggtccatccccaacccgggaccaatcccctggacgacccgcgtgtgcgcgcccatgtcgaggacggccgcttctacctgctggccagccagcgcaagtacgacatcatcacggccgagccgccgccgcccatgatggccggcgtggtcaacctctattcccgcgaatacttcgcgctcatgcgcgaccgcttaaacgacggcggcatggtcacctattggctgcccgtgttcgaaatctcgcccggcgacgccaaagccatcctcaaggccttcagcgacgtgttcgaaaacgcttcgctgtggaccggtgacaacttcaactggatgatggtgggcgtcaaaaagcccaagggccccaaaccggcggctgatttccccacgccctggaagaccgcgcccacagccgaaggcctgcgccagatcgccgtggaagagccggcccagctcggggcgctattcatgctcgacggccaggacatggccgcctacctcggcgacgccaagccgctcaccgacaactaccccaagcgcctcaccggctatcccgagtcgccccaggcccagcagcgcgacgtggccgcccacaacgcgctcatggacgccaacgcctccaaggaacgcttcgcgacctccaagcaggccgcattgctcctgccccagtccgtcaaggccgaggccgaagcctggttcgaaacccagcaaatcatcaacacctacctcaacaacatgatcccgccgccgccgcccctgccggccgtcaactacgtgctggcaggcacggacctcaccgtgctgccgctgtggctcatgaagtccgaccccaaaaaggtggacatcgtggaaagggccctggccgccggcatgccgccctcggccgagaccgaattccaactcggcgtcaaagccctgtccgaccgcaactacctgctggccgaagccaagctcaagcgcgcccaggacctcggctaccccagcaacctggccccggcccgggtctacatcctgtgcatggccgggctgctctcccaggccgaagacctggccagacaagccttcaagggcggccaggccagcgcctcggcccgagcctacatggaatggctggcccagacgttcgggttcacgagtccgttttaggggaaggctggaaatattcttttaaagcacactcaacaatccgtcgccattgcgcagggacaccattccattcttcaccccaaggctgaacagcaacataggctttatatggtttttcggaatcagagacagggataccaagcacattttcgatattctcttccaacataatcctttttgattcatcaccaagagcgtgcaaaattggaccattcatctgctccgccttaagtgtgctcaagtctctatcatgtattacaaatatatctatattcaatggcgagagataatttaaaagcgagataatagctcccttacctcgtgccttaacagcgtgttgaaaaactccgccaagtgaccgagaatccagccatcggggttccggaggtgatctgatggggcttggccgtcagggtgatcagcaggggacgatgtatctggcctgggatgagatccctcggtctcgtgggcacgctttttacgatcgtctccagcagattctccggaaagccggcttcgatggtttcgccgagaagctgtgcaagcccttctattccgacaaggggcgtccctccattccgcctggccggtattttcggatgcacctcgtggggtatttcgagggcatcgacagcgagcgcggcattgagtggcgctgcgctgattcgctttccctccggaattttctccagctttcgcccaaggagtctgtgccggatcattcctcgctcagccggacacggtcccgtctgccactggcgacccaccaagaggttttcacctgggttctcaagctgctcagcaaggatggcttggtccttggaggccgcattggcgtggacgcttcgaccatggaggccaacgcggcgctcaaaaccatcgtgcgccgggacacgagtgagagctaccgcaagatgctcctgcgcatggccaaggagagcggcatcgactctccgatagatgaggatctggctcgcatggaccgcaagcgcgtcggcaagacgctttcgaacaaggactggcggtcaccggtcgatcccgaggcgaagatcgccaagatgaaggatggccgaacgcatctggcgtacaagcccgagcacgcggtggacctggacaccggcgcggtggtggcggccgaggtgcatgaagcggacaaaggggacacctcgactctgcaaacgacgctgaaagccgctcaagaaagtctgcggcgggtcacttccacaccgccatgcccggacgaccctgcggaactggtcgcggataaaggctatttctcccgggatgtcctcaaggttctggacggtggaccatggcggacgagaatcgccgaacccaaacgcaacggtctgaactcctggcgtggcgaccaagaggcgcgacgcgccgtgtacaacaaccgaatccggatatcctcgatggtcgggaaggccatgggaaaacagcggacggaactggtcgaaagaagcttcgagcatacgctggaccggtgcggcggcatgcgccgggtctggctcagaggacgagagaacatccggaaacgctatctggtccatgtggctggtttcaatctcggcctgctgatgcgggtcaagaccggccatggcacccccaggggctgggccagtgcctggcttgcgctcatttggcctgaccagcatccctcaatggcctatttggccatcgtcatggtggtcaagggacgatgctgcgggatcatccccatcgccatcatctgcgggggagaatagccggaaacagctttttgcaacggcctgttaactacctgaacgtctgcatatactcgcgcttttacatccgctggcaaccgtgaaaaagtttctctaaggacaatatcctcagtatcgccttcaacaattataactttcttcgcaaaaaaaacccttgatatgtaatcatccatttttattagcattttaacataagttctgtctttgtcgacaagatttaaataagcatcagacacattaaatggaacaacacacacagcaccatcgacaacagacattctattaagcacctgacatggctttcttgaaagatcaatcatatatggagaatgagatgtacaaattatctgagaacttcctattgaaaggtcatatattgtatctcgcatttgatttgcagcattcgggtgcaaatatatttcaggttcttcaaatccaataatcaaagggcgagacagcccttttcttttatgtatccattcatgacggaacttcaacaaagcaaatattgcagacctaatcattcctgtcccttgatatgcaacaggcgttttaacgttactcgacatattaattgtaaaaacaggaaccaacgacttgtctgcgtcatttaaacttgctgttgcatgcaattttgattcaggaaacacactatttataacaccgttcaaatcatccatcattctgctaaattcagactcctgatcttctggatttaattcttctgccaacaaagcaagatactttacggcctttccataattgtcggacgcctcccgaatctctcgaaacaattcgttcataaatgttgccaattctccagatttttgatcaagggcagcagcgctgtgctcagctggtatttttatatataaaggcaacttactaatcaccaccgagtgaatgccaccaggattattaacccactctgacacaccagaatcgtcaacaatccagatgtcattaatttcttcaagcttttcgagttgtgcttttgataattttttatccaactctggaaacaattcttcaaccaattctgagtcaattccacggtctatcaaatccctggccttaactatgttctcaaattcacttttctttactctgctataacacttcatctctctaatgcaactttttgaagacttagaaaaagactttctaaatactacagataggccgctatcattttcattctttgtttcatatcggataagccgtcccttaaaccctctccaactatttgcttctactggcaaattcctaaattccgcttcaatagagcactcagtgcacttatcaactatttcctctgcacaaacttcgccctcacaattgtaatcaaattctgaaagagattcactcactgacagcagacatcctattgcagctaggacagtacttttaccgacattgtttggaccaatcaaaaaagttgtatcaccaaatagaattgtagcttgcttaattctgcgaaaattacgtagacacaatgagtgcagtcgcatagatatcacctcatatttttttgcaagcatacatatagactatagtctaaatcaacttgtttttcctataaatagaagcaagctatcgggacagcgcccacctatagcttttaactatttgaaatacatcaaattatgactatttaaaaaaaaaggagcaaataaatgccaacttcccttgattgccgtggtctggcctgtcccggaccggtccttcgctgcaaggaatgcgtcgagaaagacgcccccgataccattgccgtcaccgtggacaatgaagcggcccgggaaaacgtcacccggtttctgaccatgcgcggctacgccgttaccgtggccgaggccggagacggcgtctacgtcctgaccgcaacggcgggagccgctcccgtcgctgcgcccgatgccacgccggccgccaaggccgaagccggcagccgcaccgtcgtttttatcaccgccgacgtcatcggtcggggcgacgacacgcttggggccaagctcatggtcaatttcgtcggcaccctgccggagctgggcgaacgcctgtggcgcatcgtcctggtcaacggcggcgtgcgcctagccgtggccggcagtccggttctcgacaagctcaaggccatggaacaggccggcgtgtccattctggtgtgcggcacctgcctggacttttacggcattttggacaagaaagaggtcggccagaccaccaacatgctcgatgtggtgaccagtctcgatctggccgataaaattgtacaaatctgacgcgccgactttctacgggccgcttgcccggcggcccgctttgcttgcgcggagcaacgcctttctggcccagctccgccagtaggacagccagcgtgtcagcacttcaggatgtacccatggctgacgcgccattgcccacgtttttcttgccggccgaacgccttaaacagccggccatcgacgccattgcccgagatattgcccactctccttcagctttgaccttgggagcggtcccgctggccgtagtcatcgtcaacgacacccgccagatcgtttacgccaacgcccggtttctggccctggccggaaaagccgaggccagccaggtcatcggccagcgcatcggcgaggctctgggctgcgagcatgtggacgacaatatcggcggctgcggcaccacccggttttgccagtattgcggcgcggcccaggctgtggtcaaaagcctcgaaggcgaaagcggcacccaggaatgtgccatcaaccgggtttctgcctcgaccctggacgcgctcaatctgcaggtctgggctgtgcccatggagatcgaagggcacaagctggtgctcaactccgtgttggacatcgcccacgaaaaggccctgcggggctttgaacgcatctttttccacgacatcctaaacgccgtcaccggcatcaagggcataagcgacctgctttccctggaactgcccaagaactatctgcgagaattggaactgctgcgccgctccatcgacgatttacaggacatcgtcgacacccagcgcgattttctggctgtcgaggccaaggaataccggcacaactacacacgcctgtataccatcgacattctcaagtacctggcttcctactgccaatccttcaaccatggcggcaaacgccgcatcgatgtcgcgccccaggcggcagcgcaaattttctcctcggacctgcgcatcatccagcgcatcatggtcaacatggtcaaaaacgccctggaagcatccgcccccggaaaatccgtgacgcttggcgcggacgtaaccgatcggggagctgtgcggctgtgggtcgccaacccgggcgcaatgcctgaagaggtgcaactgcggctgttcgagaagggcttctccaccaagggcgaaggccgtgggcttgggacctacagcatgcgcctttttgcccgccagtgcctgggcggcgagataagcttcacttccacgcccgaggacggcacgcgctttgccctcgaactgccggcctgacgccatggatgcgacggattcgcgcctcacgcgcatcaacaaggccctggcttcggctggggtgtgttccaggcgtcatgccgacgacctgattgccgccggacgggtgacggtcaacggggccgtggtcaccgaggccgggcttcgcatcgaccctgcccgcgacgccctggccgtggatggcgcgccggtcaacttggccccggaaatcccgataaccctggcgctgcataaaaagccgggcgtggtgaccacggccagcgaccccgaaggccggcccacggtctttgacggcctgcccgaggtgtggcgcggcaagcgccttttcccggtggggcggctggactttttttccgaaggtttgcttttgctcaccaccgacggcgagctggccctgcgcctgacccatccgcgctggcacgtacccaagcgttaccgggtcaccgtgcgcggccaggtgacgccggacatgctcgggaccatggctcggggcatgcgtctggccgagggcgagcgcctggctccggtggccgcccgagtggtcgaagggccggcccaggaccgatcgattcttgaaatggagctgcatcaaggcgtcaatcgccagatccggcgcatgtgccgcgatttgggcctgaccgtgctgcgtctggcccgggtcagccaggggccggtggcgctgggcgacttgccgctcggggcctgccgcgaactgacgccggccgaactggccaccctgcgccagtcggtgggtttggacgatgcggatgtcgcaccagccccgcccaggccccggccgacagccgaaggcgacacaaaacgcccgccgcgtccagcccgtccgccccaggccggcggcaaacggccggcaaccaaggccagcggcggcgagaccgagacaggaccgcgccgtgacgggcagtctgcgccgcgccgcgaccgccctgcccgacgtcgcggccaatcttcgtaatttccacgccacggttttgtcgaagaagcctggcgaccatgcataaaaaacccgcccgagcttcaagcccgggcgggtttttgcgttatcggcaacggccgaacgcgcgccatggattggccggcctcaagcatcgggcaagccggacaggaaggcggccacggcctgctgggcctgccctctgtggctgaagatggcggcgtgttcgccgccgttcagagcggccagacgcgccccggggatgcgctcggccagttgcttgccgtgagcggcaaaggccacgtggggatcggccgtgccgtggacgaccagggtcggcacggcgacgtcctccaggggatagtcgcggctgcgggtcacggccacgtcgttgacggtcccggccagccgctctcccagacgggaccgtgtctgggccgagagttccgcgaaaagggccaaggcctcgggatcgttcatgacggcccggcgcgaggccggatcgccaaagccgcgcttgaccgcttgttcgggagaggcggctttgggtcgcaacatcgccccaagtcgggggaaccgggccgccagacgcagcatatgccaagccaggggcaagcgttccgtgatgcgcccggagcaggtggaaaccagcaccaaaccgcgcgtcaggcgcggatggccaagcgccagatgcacggcgcaagggccgccgcccgagacggccatgaccgccgccggcccgacgtccagatgctccaggagcgcggcgcacaggtcggcctgggtctcgggggcctcccggccgccgaggggtgtgcccaggtagcccggacgcgacacggccaggacgcgccaaccctcgggggccagcagccggcccaagatcgtgctttggtcatggccgcccatggctccgtgcagacacaacagcggtggaccgtcgccgtaagcggcgtactccaccggccccagggacgtctcgacgcgacagggggtcgatccggcgttcatcgcggcgtctccccggcttctcccggccgtcccaggcggcgaatgagttcccggccggtggcctcgggccggacttccacccgccggtactcccggcaatccggggttcgggccagaaggccgccgtcgcacagcatccggcgcagcagcgcggcgtcgccaaaggtgtggccggcctccaggcaggcgttaaccatcttttccgtcatgatctgccgggccggcaagcgcgaccagagcaaccacaagatcacttgctgttcgctccacttggagggccagcgcaccaagcggccgtcggcgtcgaaatgacgcaggagccggcgcagccgggcgtaatccacgggctgcggcggcgcggccggggcggcaggcgcgtcaaggcgggcttgcgccttggcgttggcccggaagtgctggaaattgcggcagccggcggcccgggccaggatgttgagcatctcgacatggccgggcgtagcctcagcatcaggaagattgccgcgcactgccttggccagggcggaaatgtcgtccacggaaaaaggaatacgttcgcgtgacatcgcttatccttgcaagcgtgcctgtccgggaaggaggatgtcggtggtcgccgtcttccgacgcggcacgggataaggtgtcggtgcggaatggatgcgttggcaggtttagcaccccttgcggggcggcgacgcctgggtgaactgccgaccggttcggggcttacgacagccggcccggccttggcaagcaaaaaaccgccgcgaccggtccggtcgcggcggtttgcgtgcgtatggacgaacccggtttagaacatgtccttttcggattcgctgatggtggcctcgatgacgtcctgcaattccttgggcaagcccatgatgtccacgttgaggaaaccccggacgatggtggaggtggcctcctcctcgtcgagtccccgggccatcaggtattcgatctcttcctgggcgatcttgcccaccgccgcctcgtgggacagctccacgccgtccaccgaacccagcagttccgggatggcgtggatgacgccgccgccgaggataagccccttgcactccaggtggcccttggccggcacggaattgccgccaataaagccacgggcgatgatggtgccgcccgaggcgatggtgcgggagatgatctcgcccttggtgtccggggcgttgagttcgatgcggctgccggtgtccacgtgggaccctttgggcgcgacgatgacggagttaaaccgcgccaccgccccttggccgttcaagcggatgaccggataggattggagatccttgacgggttttaacagcacgtagttgttgatgaagacgccgccctcttccaccgtgccgccggtacgcggccgcaccaccgtggactcggcccagttgtggatcatggtgaaggtgagcttggcgttcttaccgacgaagatctcggtgatgcccaggtgagcagcgcccttggagccgtgggccaccgagcagccggtgatgatgtgcagctcggaatcgtcctcgacgatgatgacgttgtggacgttctggccgatcatgtcgcctttgaggaacaggcacgactgcaccggctcggccaccttggcgcccttttcggtgcgcacgaagtagcctccgtggagattctcggccgccgaccgggtgaactcgtccttgtccttgtccacctgggtccagtaatattgcggcaggccgtcgtacttggccagagcgtccttgatgtccaggacttccacgcccttttgcaggcttttgcaatgcacccggccgtggtccacctgaagataggagccggcgcgctcacgctcttccacgtcgatgccggacatgagcatctcggccttgtcggcggcatcgagagtgcgcagatcagcgatttcaccaagggtcgagccggaaaaccggaaatccttgagttcgatcttttccatggcatggcttccttgggctcgtgtcgcggccacgaaacgcgcctcgggcgcttcgctgccaacaaactaaaacccttaatttttcttaaaaaatactggcgtattttttaagggacgcgacactagttgagacagcggacgcattcctggtagccatgctggctgatgtggtccaggatgtcgcggggattggcctcgcagcacagatggccgttatacagcacctgcccccggtcggcgttcaaatattcgaggatgtagccggtgtgggtgatgatcagccccgagaccggacgccgcagcgcccgctgctgcttcatgctggccccggcccgaggttccagaccggcggtcaagacttcgcgcacggtatggccgatgagtttcatgttttccaggtcgacgccggattccggctcgtcgaaaaggagcagatagggcttttgggccataagctggagcagttccgagcgcttgatctcgccaccagagaaaccggcgttgacgtcgcgctccaggaactcgtccatgttgaccttgcgcgccagcgcgtccacgtcgatctcgccctgcctggcgcacatgcgcaccagatggcgggtctttaagccatggatggtgggcgggcgctggaacgacatgcccacgcccagccgcgcccgctcgtaaatgggggcgtgggtgatgtcatggccgcgaaagaggatgcgccccttggtgatttcgtagttgccaaagcccatgagcgtcatgagcaaggtggtcttgcccgagccgttggggccaaacaggatgaaggtttcgttgtcggcaatgtgcaggttgatgccggaaagcacctcgcgttcgccgattttgacgtgcaagtcttcgatgcgaagcatgattccctcgctttttgcgccttattgggcgttgctccgcctggggtctacggaaaaaccccggcaaagtccactcttggagtcggaaagggttccagccggcaggcgggcgaggaatcagtgggtgtcgtaggcgcggatgatggccgccagttcgtcgcagtcgtagggcttggccagatagtggcgtacgccgtggcgtttgaagaaatcgatatgctggcgcacgccgtagccggtcagcaccacgatgggaatggacttgacggacccgtcggccatgcgcacccggccgatgaactcgcggccgtcgatttcgggcaggcgcatgtccagaagcaccaaatcgaagcgttcccggaccaccgcttccagggcgcttttgccattgtcggccagggtgatgcggtggccttcgtcttccagggtctgacaggccagggtagcgtgattgacgtcgtcttcggcaagcaaaatacgcaacataaattgccgttcctccctgctaagtcggagcaggaaacatgccgttttagaccatccagcaatcagctgaattcatgaatatttatgccaggcacgaccgttttgggtggaaaataatcctgctttacgacaaagcaggaaaatcatttaaccctttttatcaggtttcccgtggcccaggcaagccctgcccttaagcgcgccaccttgccgcgctgccgagcaacgcagcccggcgtttctcccatgccggccaaagccgtcagcagccgttcaggcacggcggggcggaaccgcccgagcgcccacggcaaagccgtagaggcggggaacaagcttggagagcgcctcggccacaagccaaagtccgaagatgacggccaacccgctgccgaaatagaagaccacctgttgcaagtcgccggccggccgccagacggccaggagcttcgtttgcagcacggacatggtcggctcatgggccaggtagacgaaaaagctgtgccggcccatgcgggacagcagcttgctgtcgtggatgagggtaaaggccgaggcccgccagaacgcggcgatgcccagaaccaggttggccttgaagcaaaactggcgcacgccctcgtcggtaaagcccaggggcgtccagcaaaccagcaccacggtcagcaggccaaaagcccaacacgccgtccgctgccaccaggagacgccggcaaggggcaaccggaggcgggcgacatacccgccgagatagaaggcgaacatgtcgccagcataggagtacggcccttcggacaggccggtccagaggagaaaaaaggcaatgaggcccacgccgggagcttccttgaaaaagaccagaaagaccggcgaaaccaggaagacaacgagcaggtcgcgcaaaaaccacaacggatagttgatgggcgtggtgccaaggccaaaggttttggtgaacagcccttcaccgaccaggaaattccacgagcccatcatctcgatgctgccgacaaaatagaaccaggcggccaggccggcgttaaaaagcatgtagggcacgagcaccgagacgaatttcttgcgcaacatgtcgccgtaggcggccagggacaggtcgaacttgcgcaggaacagaaaaccggagatggcgaaaaaaagcggcacggccacaaaatccacatggccgtttaaaacttcgagcaacagcgtggccaacgggccggtttcgccggcaatgcgcacggtgatgccgcgcgcgccgtgggccaggacaataaggcctatgagaatgatgcgcagcacctcgatgcgcttggaaacgtcgcggtcaatggggtcatgaaccggcccgagcatccaggccggcttggcggattcgatcacgggggtgaactcctggtcgtacgccgcaggacgcggcgtggatcaatgggcgtaggcaagcatcttgcgcagtcgtgccggggtcacggaatagccctcttcgcgcaggatgcgcacgaagctgtcgataatgcactgcgtggcaaagtctttctttgtgatgctttgggaatgcatgatctcccgcagcacgagatcgatcatgtagacgcagtgggcaatttccttgatgtccttgtctggcataccatctcacagacgactgcggccttgggaatcaggctccggcagcgactatagtcccaccaaacgcccgaccgccaaggcatcattgccttttttcaccgtgatggcaactacggggccacctggcccgccaggtcgaggacagaacacgaatccggcgcttgccctgtcccagcccaaggcaggacgcgcctggaaagccgtgcgcttggcggcgagcggaagatcggcaacaagccggagcacgggaggaaatggccgcgaggggttgcggcgcgttactgacaggattccccggaacgccaggttagccctggcgaccacatgaccgagcgtcaaatttcgggaacaacgctctggcctgcgactatgcggcgaaagcccgccccgtccaccagcccctggcggtaggccagggagacgtactcccggcggacgcggtcgataagccgctccatgtcctcgaccaagccccgcgccgcctcgccggcgtcctcgcgggccaaggcctccagggcggccaggctggcttgcagctctgtgagatgaatggccagttcgccgtcgagcccctggacattgaccagatcgtcgatgcgcgactgcaccagttccggcaaatgcgccttgcaggtgtccatgtcctcccccctggcggcataaagccgccggttgcgcccgcggatgcctcccgggcgggtttggcacgatggctggcctatagcgcaatgccgaggcggtgtaaaatgccggccagcattccggcatggcctctgatggcggccgctctggcgcgccaacagccccgagcgtacccggggctgccagggcgaagcaaggtgcgtatccatctatccgggacttcagccggccacggcacgcggccagcctcaggaacgaacgtccagtgtctgaagatcggcttcgatacgctccctggcggccaaaccggccagccagggctcgggcagcccatcccggcccgtagccgcgccgacgagcatcccggcgagcagcccccgggccgcgctgtcaccgccggccatgacgttttgacgcagacagccggagagatcataagggtagcgggccacgagatggatgacggcgggcatggcctcgtcgatatggcaggtctggcccagggcggcgatggcgtccacggtgtcgtcctcggcggaattgaggccggcagccagccattggccgatgggagcgctggcgtagccggcctcggcggccaaacgcagggcgtccaccggcgtcttgccgccaagcacggcccgggcggcccgggcgaagaattccgccgcctcgatgacccgtgcgtggttatgggtcattttggcctggctacgggcggcgtccaccagggcgggcagatcgtgagccagggcgaagaccagaggggcgatgcgggccgcaccggccaggtcgttggaattggacccggaattggctggaccttcgccgaaatcgaaaatcttgagcgtcatgcgggtggcgccgtccacatagccggcgtagccggcaaagagctttcgccagcgtatggcgaagtcgtccaggtcaaacccgccgcaagcggccagggagtcgagcagcgccagggtctggtcgccgtaatgggtcagctcgccggctttcttgccgccatgataaccgtcggccggcggatcgacataaccggcaatctggccgaaccggtcggccagggccacggtgtcgtactcccagtgcggccccagggccaaagcgtcgcccataaacgaagcccaaaccatggcgcgtgcattgtcagacatggcctctcccccgggtttaccataccctaccgcatcgctctgaaagaaccaagggcttttccggccagacttcgggctattcggccagatcacgacaaatcgtcgtcaagatcgacaatccccaagcgggcggcatagcgcacaagctcagccaggttggccagccccaacttgccgcagatgttggcccggtggttttccacggtctttttggaaataaacaactcggtcgcaatggcggctacggaccggccttcggctaaaagccgcaggatctgctgttcgcggcgggtgagactgtcgtaagccgggtcccgggggccggtcttgcgggcggcgtattcgtccaggcgcaggagcacctggggcgtgatggccgcgtcaagataccgctcgccgcgaagcaccgcctcaatggccgcgaccaggctcgtggcggcggaatccttgaccacgtagcccatggctccggcccgaaaacaggcggccaccagatccaggcgggcgtgcatggtgaccatcaccacccggcactccggggccaatccggccacgcggccggccacatccactccgctgccgccggccagacccacgtccagaagcagcacgtccggggcaagatcgcgggccaggccaaccgcgccggctgcgtcggccgcctcgccgaccacctcgaaccggggatcggcagccaatatggcggccaacccctggcgcatcagaccgtggtcgtcggcaatggcgatacgcgtccgtttcgtgctcatgagccttcctcggtcaggggaatctcggccttgatgcgggtgccgtgccccggccgggagcggatggtcagccgaccgccaagcaggcgcacgcgctcgcccatgctccaaaggcccatgcgcttttcgcacagcgcctcgggcaaccgggcctcgggatcaaagccctggccgtcgtcggcgacccgcaggagcagcagcggatgggaggcgaccaggcgggccacgatgcgcgtcccccgtccatggcggcaggcgttggccagggcttcctggagcacccggtagacggccagggaggtgtcgaagcccacggccagacgctccaggccatcggcggaaaaatctacggttagtcctgtccgggcggcggtgtcgcgacaaagggcggcggcggcctcggccagtcccagccggtccaggaccggcggcagcaggtcgccggccaggttgcgcaggctggcgatggccgcgcccagccgggccgaactgtcgcgcagcacctcccccgagtccgcgtccggcagcggctccttggcggcgagcagccgctccaggcccatgcgggccagggacaggtgctgccccacgtcgtcgtggagttcccgggcgatgcgctggcgttcggtctcctgggccttgatgagttcctgggagagccggcgcagccgttcctcggcccggcgcgaggcgatgatgcggccgagatgttcggccagggcatcaaggagatggcgttcctcgcgcaaaaagggcccttcgtcggccggcgggcgcttgtccagatagccgacttcgatgcgccccacggtctcgccgccgatgactatggcgctttcctgccgggccaccggacgccgccagttgggcgtggcgaaggtctggccgccaaggcttaggcgcacgcaagcggtctcggggtactgccaagcccgggcggccacggaacacgctccggccaggatgccggcaagggccagttcctggcgctgggaaagccgggtgatctcgtagaggcagtcgagttccttgacccgttcccgcagggcggccagggtcctggcgtgttcagcgacgtcgggggtgggcgtggcgttggcgtgcatggctgtttcggattggcgatgtggcgaccttgcctgacacgacctgtcgcgggcaagttcaccctgcccggcatagccctttccctcggccttgtcagcccagctcccgccccctcgggaacctctcccggtttttcgggttgctctcccgaaataccggatcaaattcccgccaaaaattgggacaacgtccgatttcgccgccgaccggccgacataggatgccgccaagccggttcgccgggaggaggttggcatggcgtatcacgccctgacaaacgacgcggcgctctcgccgcgtccatgcgccccattgcccgaaatggagtccgacaagccccttgaccagcaccgggagcgcaacttcgctccaaggcgcgccaacactgcgccgggcctgtccgtgacccggcttggccctggccgctggcgcatttcggcccgtttgcccgaggccgggcaggaggatctcgacatctacctggccccgtccgagggcagcgccgtacgtctgctggccccagacgacgacatgtgccgcgtgagcgtggagggaacgctgggtgaggccggagcggccaatctcggcgactgtctgctggaagccctggaacggggtccggcgcgcctggacgtggtcatcggccccaccgtggccgaggcctctcttggcgtcgcggccgtgctggaaagctttggcagggtcacggcacgactcgaaggccggccggaaatcgccatcaacgggctgggacagggttgtgtggccatgcgccaagcctttgaccggggcgcggccaaggggcgcgccagccttggggcgcaaggaggtcagccatgaccgtgctggcctggtgtctgctggccgtggcggccttggtcattctaagcggccttggccggggatcgcgtcgccacccgggccatctgcccggcgatttcgatttcgatggctacaagacccgcgagatcgtccagcgcggggtgttcgacaagaccaagtggatgtagctcagccacctcggttgcgcagcgcccgtttcagggcagccaaggccgtgcgggcataggaaaagtcgtaatactccacggccaacgcagcggacagggcaatctgctcgtccgtggcgatcccggcggcgatggcctgacgcagggccggcagagcctcagggccgacgccggcctttttcgaacaacggatgaccgctgccagggattgcgacgtcggtttcgtgccaaaggccaacacggcatactccatggcataatccggaaattgctcagggcgcttcttggcaaagcccagggcgcagtactccctggcgtcaaagagcagttcatagccgagcaggcaacagtcgtgcaaccggtccgtggactggcgcaattccttaatgcgcttgagataagacgccttgctcagtcccaggcgcacgagtttggccgtcagcgcggcaagatggatgaagaactgatcctgctccaggaaagcaagcagaagatgcagggtggcccgaagtcctgccaacgaatccgaggccgcccctttttcgagatatgcaacgccggcctcccactgccccaggcgcagatgcatgacgccgagagtgcggcaagcctccaaggccgcctcgtcattgctcgaactaacctcttcaagaagatggcggctgggagcgagggagccgccaaagcgccgggtcaggttgtatcgggccaaggcctcgccggtttgggcaacgcggtccgggaggctgaccatgacgcggtctcgggccaaatcatccagcaaggcggcggcccgttggcggctggtgtgcttgcggcggcacagctcttgcccacgcgcggccaagtcggcaaaggcctcaggggcctgttgaattttttccagggtcggcagtaaatcgtctggagaatagccaagatagtgctcgccttcccggaaatagcggcccacgccgcagccgccccgctcggtcaggagcaacgagcccgaggccagagcctgcaggaatcgcagattgaggccggaaaagaagttttcgttaaggaccgcccgggaggccgcgaagaggtccaacatggccgggcgcggcacattctggaccagatgcaagggatactgttcgccaacgtgccggatcaggttgtttcgcttgacgcgctcgggcgtcagccgtccgacaaaggtcaaaaaatgctccttggcggccggcggatcccggaaatcgccgtcaaagacgcacaagggcagccaggtggctaccacgccatggcggcgcaacggggccaccgacgacagctggtcgacgtagacatggtcaaacagcttggacagaggcaaaaaccagaactcattgagcggactgtcgatacagtaggccgccagcctgtggcggcacttatgcaaatccctgggcagctccgtccggccgaaaaactcgatcaaaacgacgtccggatcaacgtttagctcctccatctgttcgtcaagcgtcctggcggcatccagggcaaagggaaacacttcgcagcccaagcggcgaaagccctcaagcagaaaccagctgcaacacgcaattcgcacgaattcacccgtccgtcagggccgattgggcacaggggggcaaggcccgaggcctccctgggcattccccatctggctacgccccaaggagcttgagcatggtttccacctccgccgtgggcggctggcaagagccggcccggcagacatgggctgcggcccggccgtccaaggggagctggtaacgggtaaacggggccaaggcggcaatgtccggttcgtcttcgtccggccgcagcaccaccgccacttcgggcaggtagcgctcgaagatggcccgggccagagtctgtgtgtcggggccggccggatcgccggccagggtcacttccgaggcctggccaagcacctgggacaggccgcacaggaaaaaggcgtacccggcggcatgatcggccagacgcggggccatggcccgggccagggccgtggcctgttccttgaaagccggatcgccggtcaggcggaaaagcgtggtcagcacaaaataggccacgctgttgccggagggcacggccgcgtcgaagaatatcttttggcgcacaagcagctgttcgccgtcatccggggcaagaaaatagccaccctcgttcggatcggcgaaatgttcggccacggctttcatgagttccacggcccggcgcagataggccgtgtcgaagacggtctgatagagttccaccagcccccaggccaggaagacgtagtcgtccaggagcccgtcgatggccgcctcgtcgtcccgcaggcggtggagcagccggccgttttgccgcgccagccgggacagcaaggcctcggcggcggtcacggcccggccggcaagatcttcgtcgtcaaaggcccgggcggccttggccagggcggccagcatgagcccgttgttgtcggtaagcaccttgtcgtcgcaaaggggacgcacgcgtttttcccgttcggccagaaggacgtgccggcaggcttccagacgctcggccaggatttcggccgtcaggccgagcctggccgccgtctcgtccaggggccggggcaaatggaggatgttggctccggtggtttcgccggtcgcttcgtcgtgggcgttgccctcctcggtcgcgcccatggccgccatgatcagggcggcctcgtcgccgagcagtcggcgcagctcggccgccgaccagacgtagaatttgccctcgaccccttcgctgtcggcgtcctcggcgctgtagaaaaggccctcggggctggtcaggtcgcgccggacgtattcgagaatctccaaggccatggtcttgtgcgcgacgtcgcccgacgcctggtaggcctccacgcaggccatgacggtcagggcctggtcgtagagcatcttctcgaagtggggcaaaaaccaatgcgcgtcggtggcgtagcggtgcaagccgaagcccacctggtcgtagacgccgccccggcgcatggcgaccagggtgcggcaggccatgtcgcggcacgaaacatcgccggtgcggcggtattcgcgcagcaaaaagagcagattgtggggcgaagggaatttgggcgcgccgccaaagccgccatttcgggcatcgaagatgccggccaactgcgtccgggccgcgtcgagggcggcctggccgggttcggccgaggccgtgccagcggcggccgccagctgttcgcgcacggcgtccatgatctggccggcgttattgaccacggcctgccggttacccttccagaacatgtgcacgcgctggagcagctcgcgcaggccggtgcgaccgtaggcggattccttggggaaataggtgccggcgaaaaagggttccttgtccggggtgagaaagacggtcaacggccagccgccccgaccggtcagggcatggcacacgctcatgtaaagggcatcgaggtccggccgttcctcgcggtccaccttgaccgacaccaccacggcgttcatgagggccgcgatgtcctcgtcctcgaaggattcgcgctccatgacatgacaccaatggcaggtggaatagccgatggacaacagcacgggcttgtcctcggcccgggccttggcaaaggcttcctcgccccaggggaaccagtccacggggttgtgggcgtgttgcaagaggtaagggcttttctctcggctcagccggttgggggcgcggttttccatgatacatctcctcccgtgccggcaaaatagcatcggtcggcgtttttgcaaggcgtgccacgtcggcttgccggctcctggttgcctccggccggccggcgcggtaatggctgccgtgttccctagccggaggccgcaaaccatgacccaaagcgtttttctcgaccgtgtcgccgggtacgacgaccccgatttgccggccaaggcggccgccctgcttgcggccgccggttgtccggtcggaccggggcatacggcgctggtcaagcccaatctggtcgcgccgcgaaacccggccctgtcctgctcccatccggccgtggtccgggccgtgtgcctggcccttgtcgaaggcggcgcgcgcgtagtcgtggccgactcgccggctttcggcaccggacgcatcgtggccagactggccggcttcgaggaagccctggccgggctgcccgtgaccatccgcagcctggatcggccccggcggctggccctttccggcggcggtcacatcggcctatcgcgcctggccgaggaggccgaccacatcgtcaatctggcccggctcaagtgccacgaccagatgggcatgaccctttgcgtcaagaatttcttcggctgtgtctgcggctttcgcaaatccttggcccatcagaccctgggcaaggactatgaccgcttcgccgccatgattctggatgttgtcgccgccctgccgccgtccacctcgatccttgacggcgtcacggctatgcacaaggccgggccggtgggcggcgaacccttagacctgggccttcttggcgcgagcgccaatcccgtggccctggacacggcaatctatgccaccctggggctttcaccccagcgcatcccgctgtggcgcgcggccatggcgcgagggcttcccgggaccgatccggccgaactccatttccctctgctgtcgccaaacgattttcgcttcgagggctttgtggtgaagcccgaactggccccactggcctttgaggccaaacgcttcctgcgcggccggctcaaaagcctgatgatcaccctgcgcggcgggcgctgaggcacggcagttatggctgaggtcacgcgttgtcgccatgtggcggctggccaggttcaaggggtgggctttcgcccctttgtctaccgtctggcccgggaacttgggctgacgggctgggtgcaaaacaccccggaaggcgtggtcatcgaggcggaagggccggcggaagcggtttccgccttcagccgccgtttgccggccgaactgccgcccctggcccggctgctggccttttcggcgacccccgtgccccctaccggcgaagccggctttcatatccttgccagcgccccgggcagcggccacgatgtgctgataagccccgacgtcgctacctgccccgactgcctggccgacatggccgatcccggcaaccgtcgccatcgctatcccttcaccaactgcaccaactgcggcccccgctacaccatcacccggcgcgtaccctacgaccgggaaaccacctccatggcctgttttcccctgtgcccggactgcgccgtcgagtacgccgacccggccgaccggcgcttccacgcccagcccaacgcctgcccaatctgcggcccgtccctatggctggccgacgggaccggcgtggtccttgcgcgcggcacggccgccgtcgccgccctggccgcccggctggccgccggccagatcgcggcggtcaagggcctgggcggtttccatctggtctgcgacgccggcgacaacgacgccgtggccgagctgcgccggcgcaagggccggccgagcaaagccctggccgtcatggtcccggacctggaaacagccgcccttctcggcgaggtcggcccgaccgccgccgaactccttggcggcacggcccggcccatctgcctgctgccggcccgggccggcagcgcgctggccccgagcgtcgccccggacgtggccgaaattggcgtcatgctgccctacacgccgctccatcatattctgctggccgatttcgccgctgctgtcggctccgaccgcccggccgccctggtcatgacctcgggcaacgccgggggcgatcccatttgcctgggcaaccgcgaggcccttgcccgccttgcccccctggccgacgtctggctgctccacaaccgcgacatcctgatccgcaccgacgattccgtggcccgccccctggagacggccgaagccgaggcggccggcgcgccgaccctgtttctgcgccgggccaggggttatgtcccgacgcccatccggctgtcccacagcggcccggaggtggtcggccttggccccatgctcaaggccacggtctgtctgaccaagggcgaccaggccttcgtcagccagcacatcggcgatctggaaaacctggccgccttgcgcttttatgaggagaccctggaacatcttctcagcgtgctcggtgtgacgcccaagctgtgcgtggccgatctccacccagactatccgagcaccgccctggccctggagcaaggctgctggccggtcatccgactgcagcaccacgtggcccacatccatgccgtgctggccgagcatcgcaaggatgaaccggtcctcggcctggccctggacggcgtgggcctgggcgaggatggcacgctgtggggcggcgaatgtctgctcgtcgatccgacgcgcctgacccaccagcgcctgggacacttcgcgcccatggccctgcccggcggcgacgcggccgtgcgccagccctggcgcattgcccaggcctgcctatatagtcttggggaaaccgccgaggacggcccggtccggccctggatgacggaccatggctcggcttcgcgcctggtcgggcagatgctggccaaaaacctcaactgtcccgtgaccaccagttgcggccggctcttcgacgccgtggccgccgtaaccggcctgtgtctggaaaccacctacgaaggccaagcggcaattttattggagcgcgctcaggacctgaccgtggaccagccctacgagtgcccgctcttggccgaccagacgccggccgtcctcgacacgcgcacgctttttgcccaggctgcggctgacgcggcccaaggggtggcgaccggacgcatagcccggcgttttcacctgggacttgtggccgggctgacgcggctggctacggccatggctcgggcgacgggcattcgcgctgtggctcttggtggcggcgtcatgcagaacagaaccttggccttgcgtcttcccgaggcgcttcgagccgccggaatgtcaccgctggtgcatcggcgtatgccggccaatgacggttgcgtcagcctgggccaagcggcctttggcttgaggcagttggcgaccaacaattagcagaataaataattacacagtcatgcatcagctaaaaatatagatcgttttggtataaattattgacaataagagtctcccagagtaggcaacagccgcgtgcttgcgatgggtccatgcccttgctgcgatcaagcgagtctattccatcaacaaagcagccggggtatcgtcgttagccagcgcacggtggaactctacaattgtttcgaaaaggatgaagatacaagaaccgttattgttgtgctccgaccgaatacggcacagttatgaaatattccgccatcagaagccgtagtctcgaaatatataacaacaaataacgcctagcgatattacatacaattctgctacgttgccgccaagtccttgacacacttttgcattgcgtctatttttcaaaaaaagcatatttggatttataaaaaaggacattctacattaacttatctaaaaaaagttcatactgcatgtaaatacaacaacaatattatcacaatatcgccattgctaaattattctcatttttcaattttttaacaaccaattgaaaaacagtgaaatagccgcgcgctaccgtcctgttatccctatgtatttcgagagagacgacttttcagatatcgcaatggaggcgagatggataacggaaaaacacttcaggacatgatcaatcgctttgacgaggcgtttgaccgcatcaagaaagcgacaggaatgcgtacccaggtggagatcgccaagatgctggacatcagacagtccagcatttccgatgccaaaagacgccaatccataccggatagttggctgataaagctgtatcagatctacaacctcaaccccaactggatccttgatggcgagatgccccagtttctcggcgagcaacgtggaggagccttcccggttaaagaacccgtcgaagcctatggacgcaagcccaaacatcatcaaatgccggtgtattccatgacgccggacaatgtggaccagccaggcctttggcaggaacgtccagtggagttcctgagcgtcccggatcaattgcatcgcccgggtctgcttgtggtccgcatggacgagagcgatatggaacccgtcatccagcgcggcgcgtatgtcggcatcgacagggaccgtaaggccgtgcgctccggcatgctctacgcactggacatgcccgtcgagggcctcatcatcaagaaagtgcttcacgacgccgaaaacgcccgtcttgtgctgcgctccgaaaacaccaaattcaccgaccagttgttgccggccgaaaacgccgcggatcgcgttgttggccgagtcgtctgggtgatgcaggcggtttagcccacggcttttgcgaacgcgccgcgcgggcagcgccctgctgaaacgcgacttgccccacgtaattgacacgcattctacacgacaaaacgcgagcctggccttcatgactcaaaggcatgctgttgccgggaacaggctcgcctctttgtcgttttcacaggcgatcttgcaaccgatgttgcagacaggtcaaacaatattatcaatactttctgccacctgccgagaggtacctcctccttcagcgcgtggcgcctttttagcgtcttgccactggcaacgcaccacaatgtcttttgctacgggcattgacggctgccttgatgacatgtaaattttatcggtaacttatgtactactttttattatagattaatttttacgacaaccctttaggaggttgcgtgaagccggacaatttcgaggatgcctacgccaggattcaggccgccaccagggccaaaacccagacggagatcgccgccattttgggcatcaagcagtccagcatctccgacgcaaaaaaaaagaacaccattccggacggctggctggtcaccctctataggatgttttttctcgaaccggactggatactgtacggacagctcccggccgtgcgccgggaaagcggcgcagccgccgattgcgtccgggaaaccgccgtggcttatgtcgcgcctccaagccgcgtcacggtctacgccatgagccccaccgacccccagacccaggcctggattcgcgagccactggagacccttcccctgtttgaagccttgcgccggccaaatctgcttgtcgtgcgcatggacaacgccagcatggagccaaccgttcgccgcggcgcttatgttggcatcgattgcgacgatgggcggttgcgcagcggcgacatctacgccctggacatcccgggcgaagggctggtcatcaaacgcattcaccgcgatctggaaaaccagcgtcttgagcttggcgcggacaatccgctccacaagtccatcacccttcccttggaaaatcccggcctgacatccatcggcaaagcggcctgggtcattcaggaactctagcctcctcccgcccgataccttgggtgcgctcccaggccgggcgcactttttggtgaccaagttaaatcatttgccaatatattaatttacaaacaggtatagatattgtattcctaaatggttcgtaccggcaggaaccacgcaggaaaatataccaatgcccaagccgttgccccaaaatcgtctctcgtcccagcccttttcccgcgaagtcgcggtccacgccatgaacagcctggaccccaaaaccgggacctggacgccaaccatcatggaaaccatagaaatcgccgagagtctcacccggccgcacttgcttgtcgtgcgcatggaagactccggcatggagcctgtcatccggcgaaaggcctatgtcggcctggactgtgacgacgtgacggcgcgaagcggcgagatctacgccctgtccattcccggggaaggtttggtcatcaaacaggtggaacgggacagtgccgggcagcgcctgcggcttgtgtccgcgtcgccacgccatgccgcacggtctctggcccagggcggccacgcctacgtagtcgtaggccgggtcatctgggtcatccaggacctgtgacgaccaccagcccgctcggctactcccggtcgtagcgccgggccgaaggatcgaagcaaaactggcagcccggcggcaaaagctgccgcaccagtgccagtccggcggcaaagccgcccacatgggcccagaaggccaccgccgccgcctgcccttccacggccgtgccggccagccccgaaaagagctgcacgagaaaccacacgcccagaaacaccaccgccggcaggtccacgatccagggtatgacgatgatgggaatgagcgtcgtcacccgggccttgggaaacagccgaaaatacccgcccatgaccccggcgatggccccggacgcgccaatgaccggcacgggcgcgctccagttgaagagcacgtgcaccgccgccgccgccacgccgcataggatatagaagagcagaaatcgcagcgatcccagcgcttcttccacgttgtcggcaaatatccacagcacccacatgttgagcagataatgcagccaccccccgtgcaggaacatgtaggtgagaaacgacagccagccgccctcgggatagcccacgtgggcggcgtagctcgggtgggtgaagcgggccgggaccacgccgtggatgtgcacgaactcaaacagcacccgatcagccaggagttgctgatagagaaacaccgccgtgcacaggccaatgagcgtccaggtgaccaggggcggcttggtgctcggcacgttgtcgcgaaggggaatcacggcgcgtcctcgccctccggccgggacggcgcgtagccggcggccacaagggcggccagccggttccgggcgtcctgacgacgcaaagcggtcaatccggccagaagccgcccggcggccccggccaagtcctcgggcttgccggcattgtccaccacgaaccggcacttggtcagtttgcggtcctgcggccactgccagccgtccatgcgggccacaagctcctcggaccagccccgcttctcggtcagccgggccagacgcacggccgggtcgcagcgcacgcccacgaccagatccacgacctcgcccggcagccagccggcttcaaaaagcaacggcacctcggcaaatacaacccgagaggcggcatgaacggctaaaaagcccaccagctcgcccttgaccaggggatgcaccaaatcgcacacttcgcgccggaaacggtcgctgccttccatgcgcgacagcagccaggccttgtccacgcccccatcagcggccagggcctcggggccgaaacgccgggccaacatgtccgcgccgtggcccccgggggcgtacaaggcggccacggccgcgtcggcggaaaaagtcggatggccggcctcggcgaagtgggccagcagcgacgatttgccgcagcccggcatcccgaccagtcccacccgctggcagcgccggccgagcatgagcagcaaccgccagaaatcggccggcggcggctggcaaaaggacaattcctcgcccgtgcccggatggctgaaggccagcttccaggcgtggagcatctggcgtttggccagccgggccatggccccgccgcgccgggtccagtccgagtgctggcgcgcgccgtacaccgcgtcgccgacaatgggatggcccatggcggccatatggacgcggatctgatgggtgcggccggtggcgatggccacttcaagcaggctggccgtaccgtcgggcgcggtccaggccagtttccaggaactcttggcctcgcgcccgcccttggccaccacggccattttggtgggatgcttgggatcgcggccgacgggcaattcgatgaccccgtcggaccgctccgggcggccatggaccagggccagataggtcttggccacgcgccgctcggcgaaatcagcggccagggccaaccgggccgattcggtctgggcaaccagcagcaggccggaggtgtccttgtccaggcggtggacaatgcccggccggtcgccggccatggcccgcatgtccgggaaatggtgcagcagccggttgaccagggtgccgtccggctggctcgaagccggatggatggtcaggccggccggtttgttgagcaccaggacgtccccgtccagatagagcagtttgagttcgccgtcctcggccttggcttcgcttggcgtctcggggaggcgcagggtcagcgcctcgccgccccgcagcttgagacccggtttgcgacagatttccccatcgacaagggccagccctgcctcgatggcggcccggaccttggcccgggaaatgtcttcgctcgccagccgggcgctccagaaagcgtccaaacgggttccggcggcatccacgacggccgtataggccccttcctcggtcagttcgatcagtatggcttcgttttcggtcatggttccctgatacaggcggtccggcgaaaagtcgaacaggaccagggcagggatccgccaaggatttgcagccgggatcggcctggggtagcctgccgggaaacaacctcggcaaggagcgttcatgcaagcggtgattttcgaaaacggcgcggcgcggctgacggagcgtccccgacccgaaccaggtccggacgaggcgcttgtccgggtgcggctggccggggtgtgcaacaccgacctggagctcttgcgcggctacatgggctttgccggcgtgcccggacatgagttcgtgggcgaggtggcggccgcgccgggccggccggaactggtcggccggcgggtcgtggccgacatcaacctcggctgcggcgtctgtccccgctgccgcagcggcgatccccgccactgcccggaccgtacgaccctcggcatcgccggcaaggacggcgccttcgccgaatacctgaccgtgccgacccgggccatccatgtcgtgcccgacacagtcggcgacctggaggccgttttcgccgaacccctggccgccgccctggaacccggccagcagctgcatctgacggcccggaccaaggcgctggtccttggcgacggcaagctcggcatcctcaccgcttgcgccctacgccatctcgtgcccggcctcgtccttggcggcaaacacgccgccaagctcgccatcgccgccgcccagggcgtgaccacgcgccagggcgacacggccgaggcgctggtccaaggattattgcaggaatacggccgcttcgacgtggtcatcgaggccaccggccggccccagggcttggaaaccgccctggacctcacccggcccgaagggaccgtcgtgctcaagaccaccaccttcgcgcccacaagcctcaacatggcccgggtagtggtggacgaaatcagtctggtcggctcgcgctgcggcgacacggccctggccctggcctatctccgcgacgggttggtggacgtgacgcccctggccgaagccagctaccccctggccgcgttccaggccgccctggaccacgcgagtcggcctggggccatgaaggtgatcgtggacatggacatggacatggagaagagtgcctccggcggccaaaggggctgagcccctttggaaaccccacctggggaacgaaagagggccgggggttagacgtcgaggagggatttgcgggtggcggtctcccgggtcaggccgccgagcagggcggcaaaggcctcgggcgacaggatcgtgatgcccagggcttgcgctttggccagcttggagccgggatcggccccggccaccagatagtcgagtttcttggacaccgagccgaccacgacgccgccggccgcctccaccagcttttgagccgcctcgcgggtcaggtccggcagcgcgccggtaaagagaaaccgcttgccggtcagcgccgtctggacggctggcgtctccggcttggcctcgcccaccggccataagccgatccccttgaaccgctccaagagttcccggttagcctcgttggcaaaaaattcccgaatggagccggccacttccgggccgatgtccggcagggccgtcaattcttccaggctggccgcgcctagggcgtcgaggtcgtggaagtgcccggccagggtccgggccgtgcgcgtgcccacctgccggatgcccagggccgcgatgagcttgaccaggctggccgattgcttggctgcggccacggcggccacgaagttggcggccgacttctcggccatgcgctccaaggggagcaggtccgcctcggtgaggtcgaacagatcggccggactcttgaccatgcccttgtcgatgagcgccgccacccacttggctcccaggccttcgatgtccaggccggatttcgacacgaaatagctgatgccccggcgcaacatggccggacaggccagattgacgcaacgccaggccgcttccccctcgccccgaacggcgtccgaaccgcacgacgggcagacatgggggaagtcgtaaggttcggcctcggctggacgcttgtcctccaccactcgcaccacttccgggatgacgtcgccggcccggcgcaccacaaccgtatcgcccggccgcaggtccttggccttgatctcgtcctcgttgtgcagcgtggcccgggccaccgtcaccccggccagactgaccggctccaggatggccaccggcgtgagcacgccggtgcggcccacctgaacgtcgatatgtttgagcacggtctcggcctcgtgggccggaaatttgagcgccacggcgaagcgcggagcgcggtcggtaaagcccaaggcctcctgcaaggccaggctgtccaccttgaccaccaccccgtcgatctcgaagggcaactcctggcgttgccggcccatggcctcgaaatagggatagacctcgtcggccgtgaccacttttccctggccggccacgggcaggcccagggccttaagtccggccatgaccgcgctgtgggtcgcccagcccggtccggccaggccgtcgccccagtcctggctgcccacggcgtaggtgaaaaacgtcaagggccgggtggccgaaatgcgcgaatcgagctggcgcaccgagccggcagcggcgttgcgggggttggcgaagaccttgcccccctgctcccgctggcgttcgttgagctcgtagaaatcctgccgggtcatgaccacctcgccgcgcacctccagcagccgcggcacgggcagcccggcccgggcggcatgagggcgcaggtccagagggacgttgcgcaccgtgcgcacgttttccgtcacgtcctcgcccacctcgccgtcgccgcgcgtgagcgccccggcgtaaacgccgttttcataaatgatttccagggccagcccgtcgaatttcggatcgacccaaaacgccggcgcgtcgaaggccacgccgtcgcgctccagcttgttggccgcccgggtcacgaaatcgcgccattcgtcctcggccatggcgttgtccaggctgtacatgcgccgccggtggggctttgaggcaaagccttccagcaccgccccgcccacccggcgcgtgggcgaattgggatcggccagttcgggatgggcttcttccaacgccttcagttcgcggtacagggcgtcgtaggccgcgtcctccaccgtggggtcgtccaggacgtagtagcggtagtcgtattcgtggatcaggtcgcgcagttcgcgcagacgcgcggcgggatcgatggtgctcacggcaatcacccttatcagtcacaatcttccattcggttaagcccggcgtcgccgttgaaaatcacctgccacagccgttcaaaggcatggccggtgttgccggcgtcgtcggggtcagcggcgacgatgtccagggcacggcggtaaaaggccaacggccgggccaggatgcgctgtcgggacacgaaaaacatgccggccggggccggcactagaaagtgctccgggaccgggccggaaaacagcttggcatagacctcgcccaccgggatgtcctggccgaagcccggccgatggccgtggcgggccggatcggccagatcgtggggccggcccagccggtcgcacttgagcttgaaggcggcaaatcccgaaaagtgcaggcccagccgggcgttttggcgcacccggtcggcaaagctctcgggcgtcgcgccgggcggcatatgctcgaagggcgcgccctggacaaaggccgtatagccggccaggctgtcgtagcgcccgacgatgtggctcaaataggtgtggctctcccggccgatgttgggcagggacagctcgcccggcgcgccggacttgtcgtagatcgtcaccggcagccccaggccggccgtccaggccacgtcttccctatagcgggccaccacgacttcgagatcgggcgcgctcaaaggatggcccgcagcccgtccaggccgtcgctgcggccgaccagaatcatggtgtccccggactccagcacggcttggggctggggattgaagatcatctcgccgccggcctttttgatggccacgatgatgaggttgaagcgctggcggatctgggagtcgatgagatttttacccacaacgtcggaatggtcggtgacttgcagctcttccatttgcaggccggcgggaccggtgcggccggtgagttccaggaagttgaccacggtcgggcgcagcacggactgggccatgcgcacgccgccgtagaggtggggcaccagcacctgatcggccccggcccgttgcaggcgctgggtatggccctgggcgtcggcgcgggccacgatgcggatagccgggttgagctggcgggcggtcagcgtcacgtacacgttggccgcttcctgggtcagggcggccaccagggtcttggcccgctccaggccggcggccagcagcacctcgtcggcggtggcgtcgccggctacatagggcacgccgtgttcgtcgaggagccggatgacctcgggattgctctccacgatgaccacgggcacgtcctcggccaggatttcccgggccacgatggagccgatgcggccgtagccgcagatgattacgtgatccttgtagccgtcgatgaccttttgcatgcgccgtctcccgagatactgttgcaagcggccttccaccaacacctgggtgaaggagccgaccagataggcgaacgcgcccacgccggagacgataagcaccatggtcaggatgcgcccgtttcgcgacaggggatagacttcctggaagcccaccgtggaaagggtgatgaccacctgatagaggctgtcgaaaaagctccagtcctccacccgcatgtagccgacgaggccaaagacgaagaccagggccagggccaggaagccgccgatgagcggtccccagtgccccaggcggttgttcaggcgggcaacgcggcttcgcagccgcatggtcttgcggacggtcacaagctagcccatttccagcagccgctgacgcagggtcgcggcctggtcgcggaattgggccgctttttcgaattccagggccttggccgcctcgcgcatctcgcgctccacctgcttgagttttcgttccatggcttttttcgacatgccgccgtaggcctcggcttcctcatgtacggccgcaccggccccaagccccccgccggccgtggcgtagccgccgccggaagcactccaggacccggtttttgcgtcgcccttggcgtacagggagtccagcacgctgtccatggccttgaccacgctgcggggcgtcaatcctgtctcgcggttggaggcctcctgcttctcgcggcggcgggcggtctcgtccatggccgcgctcatggagcgggtcatgttgtcggcatagaggatgacccggccgccgacattgcgggcggcccggccaaaggtctggatgagcgaacgggtggaacgcaggaagccttccttgtcggcgtcgaggatggccaccaacgacacttccggtatgtccagcccctcgcgcaacaggttgatgccgaccagcacggcaaattcgccctggcgcagggccttgatgatggccacccgctccagggtgtcgatgtcggagtggagataacgcgaggtgacgcccatggagttaaagtattcgttgagctcttcggccatgcgcttggtcagggtggtgaccagcacccgctcgccggccgccatgcgcttccggcattcggccatgaggtcgtccatctggcccttggtgggccgcacctccacttccgggtcgagcaagcccgtggggcggatgatctgctccaccacaacgccctcggagcgggtcagctcccagtcgccgggcgtggccgagacatagacggcctggcctatgcggcccaggaattcctcgaaattaagcggccggttgtccagggccgagggcaggcggaaaccgtagtcaacgagcgtctgcttgcgcgaacggtcgccggcatacatgccgccgatttgcggcacggtgatgtgggattcgtccacgaacaggatgaaatccttggggaagtagtcgagaagcgtatagggcggatcgccggcctgccggccgtcgaggtggcgcgaatagttttcgatgccgttgcagtagcccagctcctcgatcatttcgaggtcctgcatggtgcgcatttccagacgctgggcggcgagcagatcgtttcgcccgcgcagttcggtcaggcgcaggcgcagttcctcgcggatgtcggacacggcgcggttcaagttggcgcggtcggaaacgtagtggctggccgggaagatgatggccttgtccatggttccgagcacttcgccggtgaggggatcggtctcctggatggcttccagctcgtcgtcgaaaaattccaggcgcaacgcccgttcccgggcataggccgggatgatctcgatgacgtcgccgcgcacccggaacacgccacggtggaaatcgtagtcgttgcgctcgtactggatctccaccagccgggccagcaccttctccatgccgatcttttcgcccacggacagcgtcaacaccatgcgctcgtagtagtcgcgcgaccccaggccgtagatgcaggacacggaggcgacgatcagcacgtcgcggcgggtcagcagcgaatgggtggcggcgtggcgcagcttgtcgatgtcgtcgtttatcgacgagtctttctcgatgtaggtgtccgtgcgcggcagataggcttcgggctggtagtagtcgtagtagctgacgaagtattccacggcgttgtggggaaaaagccccttgaattcgctgtagagctgggcggccagggtcttgttgggggccatgaccagggccgggcggttgagcttggccaccacctgggccatggtgaaggtcttgcccgtgccggtggccccaagcagcgtctggctcggcacgccctggtcgaggttgcgggccagttcgtcgatggcttgcggctggtcgccgcgcgggaggtattcggattcaagctggaaatgcatggcgttttcttttatatcccctgtcgacccaatccaagcgaaaaccctcgcggcgtccgggtcggcggccgtccgccggtccggggacagcccatccctgcaaggagacgcctcatggaaatcgatgtcgttccggcggacttccatctgcccgtggaccgggcctggaccgtgtccattgtcatcaaaaccttcaagggccgcaaggacgtcaccgtccatctgttccgcccggagtgggacgcggaagaggtcgaaatttacgactgggacgtgctgctcggcgatccggtcgatcccgacctgcccgtcagcttcgagagcagccgccgggtgctcctcgaagccttcaccgaggaagagcgcgacgcgctcatcgagtatatcaagacccgctaccaggacaaggtgtcggaggtgcatggctgcgcgctgaacatccccatccccctgggcctggtcgccctgtccgagctggccgaaggcaaggatatcggattcatccacttcgacaaaatccccaattattcgctgcccttccccgtgcgcggcttctacgacctgagccagcacaagcccatcatcgaaggcttggactagttctttcaacggtttcgacttcctgaagtcgtttcaaggggccgcccgggcggccccttttcctggagttgttcgatgcaaagcgtgtgtgttttttgcggttcgtcgtccggggccgaccccatctatgtcgatgtcgccgaccgtctgggcaagctgctggcggccgagggcatcaccctggtctacggcggagcctgcgtggggcttatgggcgcggtggccgacgcgaccctggccgccggcggcaaggccatcggcgtgctgccggatttcctgcgtcgcaaggagctggcccatccgcgcctgaccgaactgttcgtggtgtcgtccatgcacgagcgcaaggcgcgcatggccgagctggccgacggcttcatcgccctgcccggcggcatgggcaccctggaagagttctgcgaaatcatcacctgggcccagctcgggctgcaccaaaagccgtgctgtctgctcaacgtccaggaatactacgagccgctgctgcgcttcgtcgaccgcatggccggcgaaggattcctcaaggagcagcaaaaagggctggtgctctcagcccccacgcccgaagaagcgctagccgccatgcgggggttcgagccggtgatcgtgcccaagtgggtggatcggaaggagcgggcgtagggattcaccccttgccttgacagcaaaaaatgctatcatagaatcgtgaacagcgcgcagacggaaatccttcgagccatcttcgccaagccgacggcgaagaacattccttttgcatcgatagtctctctgctgctggcgctgggttgtgacatgatcgaaggggccggttcccgggtgcgttttgtcaaaggcaacgccgtacttctgtttcatcgtccgcatcctgccaaggaagccaagccgtatcaggtcaaggacgcccgcaatttcctcgtggctctgggcatcagcccagacaaggagccaaaatatgaaccccatgacctacaagggctacgccgctcgcattgaatacagcgacgaggacgactgctttgtcgggcacatcgccggcatcagcgacatcgtcggctttcacggcgaaaccgtgcagcagatgcgcgacgccttccgcgaagccgtggacgactatcttgtgacctgcgccaaggccggacttgagccgaaaaagccctactccggcaagatcatgctgcgagtctcgccggagttgcacgccaaagcggccatgatcgccgccgcccaaggcaaaagcctcaacgccctggccagcgaggctcttgagcagattgcctctggtttataataacacaacgttgccttatgctgcgggaagcggatattgtcatccgtgcgggcgcgccatcaatggccgcaacgcgcacaggatgggaataatcatggcagacgcatcaagaccgcagccggtcaagccagtccgctccacacgccaggacttcgacggtccgggcgatttcgccagcaccgaagaggccttggcctactacaaggccgaatatgcgcggttaaaggcgattattgctttgcagaaggggaagattcggaagttggttggggagacgcacacctagtcgtcctaggcaacacccacttccccaccatcccctcctcttcccgcgcggcttccagccgccgcaagaactcatttctccgcacttgcaccgcgccgaagcgcagcaagtgccctgtcgcctgctggcagtcgatgaagcggaattcgtggcggtccaggaaacggcagagcgtcacgaaggccactttcgaggcgtcggttgcgcggtggaacatggattcgccgaaaaaggccttgccgatggccacgccgtaagccccgcccacgagttcgccgttttgccaggcttccacgctgtgggcgtggccggcggcgtggaggcgttcgtagccttcgatcatgtccggcacgatccaggtgccgttgtcggcgtcgcgggggacggcggcgcagccgcgaatgacgccggcgaaatccgtgtccagggtgacggtgaacttgcccgagcggatggtgcgttccaggcgcttggacacccgcacatggccgggcacgaggatggggcgcgggtccggcgaccaccacaggatggggctttcgtcgtcgtaccacgggaagatgccgcgccggtaggcggccagcagccgcgccacgctcaggtcgccgccgacggccaaaagcccgcccggttcggccaagtgggggctggggaacaccggttcgtcgatgagggcaaaaacaggcatgggtttccatatgccgcaacccggaccggggcaagaccgggcggcttcccgcgtcacaccgaacactcccctttccgccataaaaaaccgggaccgcccatggacggtcccggcatcagctttcttccatcaagcttcgtctttccaacgaagccgcatcacttctcgccccctcccctctaacctttcggggggtccgggggcctcaggcccccggccgccggaggcatcctactcttctctcttccctcttcaactcttcacctcttcacttctcttcccaactctctcccctattccgcatccgccgcttcggcgatgggctttttcggggcgcggctggtgaaggtgaagctgaacagttccggtgcgccttcgggggcagcgtcgatggtggcctcgccgcccttttgcagtttgccgaagagcatttcctgggccagggtatccttgatctcgacctggatgacccgggccaggggccgcgcgccgtagtcggcgtcgaagcccttttcggccagcctggccacggccagcggcgtgaggcgcacgaacacgcgcttttcggccatttgcgtgttcagttcgcggatgtacttgctcacgatgcggtccatgacctcgggggtcagggacttgaagccgatgatgccgtcgaggcggttgcggaattccgggctgaacagccgctcaatggcctttatgcccttgtccgccgcgtcactggccttggaaccgccgaagccgatgttcttggtggacatctcgcgcgctccggcgttggtggtcatcagcagaatcacgtggccgaagtccgccttgcggccgttgttgtcggtgagcgtggcgtagtccatgacctggagcaggatgttgaacatgtcggggtgcgctttctcgatttcgtcgaggagcagcacggcataggggtgcttgcggatggcgtcggtgagcatccccccctgatcgaagccgacgtagcccggaggcgcgccgatgagccgggccacggcgtgcttttccatgtattcgctcatgtcgaagcgcaggaaatggacgccgagcacggcggccagctgcttggccagctcggtcttgccgacgccggtggggccggccagcaagaacgagccggtgggcttgccggcgttggccaggccggcgcgtgagcgcaggatggccttggcgatggcgtccacggcgtcgttttgaccgaagacgagatttttgagttcgccttcgaggttttccaggcgcaccttgtccgaggaggtgacccgggcggccggaatcttggccatggcggccacgacgcgctccacctcggccacgccgatggctcccttggcggtggtaccggccagcttgcgcacggctccggcttcgtcgatgacgtcaatggccttgtccggcaggaagcggtcgttgatgtggcgcgaggacagctccacggccgagcggatggccgccggagtgtagcgcacaccgtgatgggcttcgtagtagctgcgaaggcccttcaggatttcgacggcttcttccacggtgggttcgcccacgtcgatcttctggaaccggcgggaaagcgcccggtccttttcaaaatggttcttgtattcctcgtaggtggtggagccgatgcagcgcagcttaccggacccgaggacgggttttaagatgttggaggcgtccagggtgccgccgctggtggctccggccccgacgatggtgtggatttcgtccacgaacaggatggccccgggcttttgctccagttcggccaggacgctcttgaggcgctgttcgaaatcgccccggtacttggtgccggccaggagcgcgcccatgtccagggcgtagatgagcgtgtcctggaagccttcgggcacgtcgcccccaacgatacgcagggccagaccctcggccagggcggtcttgcccacgcccgggtcgcccacgaagatggggttgttcttgcgccggcgcagcagcacgtggatggtgcgggtcagctcgttgtcgcggccgatgagcggatcaatctcgcccttgcgggccttggccacgaggtccacggtgtactgctccagggccgagccgccggccttgccgtcgcgctcctcgcccgagccggcaccttcgggagccgcctccttgccgccgccgtgggagatgtactccagcacgtcaagccgcgagatgccgtgggacttcaggtagtacacggcataggaatcttcctcgtcaaaggtggcggccaggacgtcgccgacttcgacttgggtcttgcccgaggactgcatctgcatgatggcccgctgcaggacacgctggacgccaagggtctgcaccacttcggcgttggtctcctggggcagggtttccatgtgatcggtgaaaaagcgttcaagctgatgcttgagacggacgacgttggcgccgcaatggaccaggatatcccggccggtctcttccaggagcatggcatagagcagatgctccagggtgaggtattcatggtggcgacgcttgacctctttgacagcgctggtcaacacctgttcgagctttttgctgagcattcagacctcttccatgctgcaacgcagggggtagccgttctccttggccagccggtggaccagggagaccttgagttcggccacctcggccgtatagatgccgcacacccctacgcctgtgttgtggacattgagcatgatctgcgtggcttcgttttcgttcttgcgaaacacgctgacgagcaccagcaccacgaattccatggtggtgtaatcgtcgttgtgcagcatgactttaaactgtctgggttcgcggacctcgtcctcgacgctgaggccaacgccggactgttcgtcttccatgggatggctcatgagcttgccgatacctcttccaagtggttggaccgtcgggaacacttccccgaatttcccacctcggcgatagataagtcgccaacggcggctgtcgaggggcacggaaccgggcgattgccggccctttgtccatgatagaatctaggggaaaacgcggccactgacaaccgcgttgacatcaaactgaaatcgttggggcttttagggagcggcagcgagttcggccagcaggcggcggcgggcgtcgggggcgaagacaaaactcgtttccggcggcagattgcggcggcgacggtattgctggtggagttcgtgataggtttcggtgagcgcctgctccatggacagccccagccgtccggccagggggccgatggcctcggccgggccttcgatctccaggtaaaggccaaagggcagctcgtcgaggcacacgaggcaggccccggcctgccaggtttcgcggaccttttcgtagcgcagaaacggcaggtagcccaggacgccgaaagcggcttccagggcggccggatcggccacctcggtctcgatctcccggcgcaccttgagtccgggccggcccggagcctcgacgggcgtcttgacggtgaccttgcaggcggcgtcgcggcgaaggcgcagcagcacgtcgcgggcgcgcagggagccggccgcgtcgtccaggaccacgttctcctcaaagcggcgcgaaagcagcaggccaccggcggcggccagggccgcacgcacgggttcaaaggatttgacggcgaacttggtttcgatctcgtcgcccatggacatacagcgaccttccttacggcgctctacagagcggctcttctcggacgcgcggcacagcccgaacgacaagttcggggctgggccgggcgtcggcaaacggcttgcggaccggctcctaatgggagcagtagcgcactacttcgaaggctatcgcgccaaggggcatgatcttgtccgcgccgccgagcttgatggcttcctggggcatgccgaagaccacgcaggtggcttcgtcctgggcgatggtgtaggccccggtttcgtgcatctcgagcatgccggccgcgccgtcgtcgcccatgccggtcatgatgacgcccacggcgttttttccggcgtagcgggcggcggagcggaacagcacgtccacgctgggccggtggcggcgcaccagcgggccgtccttgacctcgacatagtagcgcgcgccgctgcgcttaagcagcatatggcgattgcccggggcgataagcgcctggccgcgcaggatggtgtcgccatcggcagcttccttgacggtgatacggcagatgccatccaggcgcttggcaaaggcggcggtgaactgttcgggcatgtgctggacgatgacgatgcccgggcagtcctggggcatggcttcgagaaattcgcgcagggcctcggtgccgccggtggacgcgcccacggccaccacccgttcggtggtctggaacatggccttgccggtgggtccgggcagcacggcgtcggcggacagcttgggcgtgaccttcatggggccggccggggccatcttcttgatcttggcccgggcagcggccttgaccgcgtcgatgacccggatgcgcgactcctccagaaactgccgggtgccgagcttgggcttgaggatgatgtcaacagccccgtattccatggcccgaagcgtggtttccgagccggattcggtgagcgtggaacagatgaccaccggaatcgggtgctgggtcatgatttttcgcaggaaggtcagcccatccatgcgcggcatttcgatgtccaacgtgatgacgtccggggcttgcgtctccatgcgtttgaccgcggcatagggatcgctggccgagccgatgacctcgatgtcggggtccgaagccaggatatcggtcagggtctggcgcaccagggcggaatcgtccaccaccaggaccttgatggtcttgctcacaaaaacctcgtattcctatcgggtaaccttatatcttcctgtataccgtaggagcgtgctggcgcaagggcaagtccatgccagtgaggctctcggaatggccaatgaacaaaaagccgccgggcagcaattgggtgcagaacttctggagtaggcgctcctgggtggcccggtcgaaatagatcatgacgttgcggcaaaagatcgtgtcgaggggttcggggaaggcaaaggcgtccatgaaattgagccgtcggtaatccacgatgcgccgcacttccggggcgatccgcaccaaccgcttcgctttgtccttgctgcgcaggaaataccggcgtttgagatccatggacatcttggccaggcgctcctcggggtagatgccgctttgggccattgccagcacccgggtggaaatgtccgtggccatgacgttgaagcggaagccggcaaagcggctggcgaattccgacagcacaatgcacagggtatagggttcctcgccggtggagcagccggcgctccacagtcgaaacggccgcccagtgccgtgctggctgcgccacaggggcagggtctgctcggtcatgatctcgaaatggcggggttcgcggaaaaattccgtggtgttggtggtgatgacgtcgatgaggtggacaagttcctcgtcgaggccttctgcgctgaagagaaattcgaagtagtcgcggtagccggtcttgccgagcatacgcaaccgtttttgcagccgggcctccaccatcactttcttggacaagggcagcttgatgccgacttcggtgtggatgaagtcgcttaagcgcttgaactccttgtcggtcatggcaaccaggccggaggcgcgtccgggtgcgacatccgaaaccatggaaatcaggcctccctggcctcggctccggcctcgcccagggcctgggccagtccggccagctccatggagctgaagaccttgttgatgtcgaggatgatgatgaactgttcgccggacttgcccatgccccggatgtagtcggcccggatgggcgtgcccatgcggggcggcggctcgatctgggaggactccatctcgtagacctcctggacggaatcagccaaggctccaagcaccgtgggctcgccttcgatatccacctcgacgatgatgatgcaggtgttgaccgtgcgtgccgtgctgcccatgccgaacttctgtttgaggtccaccaccggcacggctcgtccgcgcaggttgatgacgccgcgtatggcttccggggtgcgaggcacccgggtgatgttgaccagttcgagcacttcgcgcaccgaggcgatgtccagggcgaacagttcccgttccagggtgaaggtgagatactggttgtcgttgctgctgacggcctcggccatgtcgtcctcccgctctcgcggcgttgttgcctgtccgccgacgcacggggcaggcccgcttgcggcgttggtgaaagagatcgtcccgggccggccgggacatggcggggcgcctgcttgggagcaattccaggggtcaggagcgcccggcctcgaactgggcctcccggcgcaccagggcggccacgtcgataataagggccatggaaccgtctcctcggatggtggctccggaaaaagcgtccacgtcgcggtagagtcggcccagggttttgatgacggtttgatgttcgcccacgacccggtccacggcgatgccgatgcgctcgccgtccacccgggccaccacgatgggttcgatggacggcggctcgccggccaggccgaaggcctcacgaaggctcaggaccggggcgacctcgccgcgcagattgacgatgcgccgacgctgtccgtccgcgtcccgggccaattccacgcactcttccacaagcgccaggggcacgacaaagtattcgccgccggcctgcacctgcaacccgtcgatgatggccagggtcaggggcagccgcacggcgatggccgtgcccttgccccgctcggagtcgatctccacgctgccgcgcagggcgtcgatggcccgtttgaccacgtccatgcccaccccccggccggagacgctggtgacggccttggccgtggaaaaaccgggctggaaaatgaggtggtagagttccttgagcgtcagatccgcgcccggggcaatgatcccccgctgctcggccttggcccggatggcggccggatcaaggccgccgccgtcgtcggcgacggtgatgcagacctcgccgccgacgtgggcagcggccaggctgatgcgtccgacggccggcttgcccacggcctggcgctcggccggggattcgacgccgtggtcgatgctgttacgcagcaaatgcaccagggggtcgctcaagcgttcgatgacggtcttgtcgagttcggtctcttcgccgctggtcacaagctcgatgtccttgccgagttcggtcgacaaatcgcgcaccagccggcggaacttggcgaaagtagccccgatgggcaacatgcggatggacagggtggaatcgcgcaggctttcgcttaagcgctccagatgttcggccagcccccgaagatacgggtcgccgcgctcgtccacggcctggcggatctgggcctggacaatgaccagctcgcccaccagatcgaccaggaaatcgagcttgtcggcggccacccggatgctggaggccttttcctggcggtcggcctgtttctggcccaggtcgcgcacggcggactgttcggccagggccgaggccacctgacttggctgcaccaaaccctgatcggccaggatgtcgcccaggcgcttctgggcggacaaggcattttccaggtcagccggagtgatgtcgccgcgttcgaccagaatctggcccaacagcttgtggacgccctccccgtccagggcgcagccgtcgtccaagagatcaatggtcaggtcgcattcatcttcgacgaaaagaaagacgtcgactaggtcctggcgagaggccggcgaacgcagcacacagtcccaccagatcagacaggcttccggatcgaggtcgtccaggggacccacggcctcgacatggacaaacatccggcattcgcccagggaacagacgtcttccaaaaggtgcaagggattgttgcccgtcaccaggatgtcgccctgggggcggatgcgcagacggtagatacgggcgacccccggcgactcttcctggggcgcgggcaaagcggcgtcggccggggcggcatcctcgccagcgtagcggcgaaagccttccagcaacatgcggccggcggcggtcagcccggcatcgccggcattgtcgggttcaagcagagaccgaatatgatcgcaagcgtgaaaggacaggtcaagcagctcccggctgacgccgagcaggccatttcgcaccttatcgaaaatggtttccacatcatgggtgaaggcggcgatgtcatcgaaaccgaacatcgcgccggaacccttgatggtgtgcatggcccggaaaattttgtggagcaggtcggcgtcgccgggcgtgcgctccaactccaaaagcgacgcctccaggtcggccaggagttccttggcctcttcaagataggccagccggtggacgtcgtcctgggacatcatggcgtactcgactctcctgttccccgacaggccggggcatgcctcgccgcgcgcggcaggccctcggcctggcggctcctgacccttgctccagccggccccttaaaacaactccacgttatcgccgaaatccgaggcagccccgtgcgccggcgcggcagcaacggctgcccggcctggcaatgccttggcttttggcgatgcgccgaaggcggcctcatgcacgtcgcgttcggcctccatggtatagcggtcatagagctggcgtagccgggcgctgcgccccttgccgccgcccggggcaatctttcttgcgacggcaatctggccatccagagcgcgccggacctcggacaaggaacggccgatctcccggtcgaagacgatgcaccgagagagttcgtcggcccggccgccccaatcccggctggaatttcgcagcaacgtaaaaagctcctggcaacgcgcggcggacctcgtggtttcggtcagcacggcgtccagttcccccacgacccgccacgcttcggattgatcgttataccggctggcgttttcctgcaagcccttcgaagcactggcaatatttcccagaatacgggccacggcgtcagtttgtcggcgagcgtcggcggacaggcgttggatagccagggccaacacgcccagggccgcgccggccgtgccggtatgggcggccttgatgctggcgtttatggcgataagttcgatctccgcgcccacttcttcgatggcctcgatggccccgctcatgccagagacagtctcggccacggcgtccatgttgtgacccagggcctcgccttcggcggcgaaatcgcccagttcggccttgaccgtggccacgccggcctcaagacgggaaagcggcgtgtcgtcgccctcgccgccggccaagccggcgatggaatcgcccatggcccggatgcgtccggcgatggattccaatgaaccgcgcagggtgtcggcggcccggatgaaatgattgtcggcgctttggatctgggaggactgcaaggtcaggacatcggcggtaaaggcggccagttcctccagagccggggagtcggccgtcgtatcgacctcggcggcgagcatggccgcggtttccccgatggcctgctcggcatgctcgacctgctggcgcacgatgtcgtgaaattgcatggaacgcacggcctgaccgatgtcggcggcaatgtcggcggcgctgcgcgagagatcctgggaaatgtcgatggaacaggaggccatctcggccagagccttgatgttggccccaagctcccgcacgatgacctcgtggcactgttcctgggtgccaaggatggccatgttgcgctgccgggccgagccgacatggccgcgcagggtttcgatgcgcccggcgataccagcgcagtggctgacgatctggttggcaagcttttctacgtcgtcggccagggtggtgaacccccggccatcggctccaagccgggcgctctcaatgcgcgtggcaatgccgagcatactcaagtgcttaacgattttggagaattccgacaaaatagcggagagttcatcaacgatgaccaccacagcatcgatctcgtcgaggctctggcggccggcggcccgggcggcctcgttggtcaggctctcaagttcggcggacagggcacgcagccggtcgtgcatgtcctgggccgaggtgcacgccaccagttcctgggcgttttgggcgatgttctcgcaactgccctgcagaccatacaaggcctcgccaagatccagaaaatcctgttcccgggccttgacggcgccgcttaggccatgaccggccctgtccaagctgacacggcactgccgcaacatgcctttggcgtcggcgagctggatcgtatcggccatgtccctacccttgtcccggttttaacgacgccaggaccgggcagcgcccgtgcggcaccgccggaccggcagcctctcccgtgctgggagttctcatctaagagaaaactgccacgtttttcgagaaagagcaaagcgttcttgtcacacgccgccgcgacgacgacgcaaggccttgcccagccacacgccgcaggcaatcaatgcgacaacgcccagtatggccagttgggcgtgatgcacattgtcaagcatccgggtcagaacattttccagcaggctgccgaagccgtagccgatgagcgcgaaggcgacggcccaaatgcccgcgccaatggtgttgagcaagaagaacttgagcacggatatctcggccgtgccgaggacgaaaggcgtgaggttacgcaggccgtaaaagaagcggaaggtcaggatgagcacttcgtggtattttttgagcatggcgtggacccggtcggccctggcgcgccatttctcactgcgagcgacaagttttcttccgtagtgacggccgatgaaaaaggcggtctgatcgccggccaagctgccgcaaaaggcgcacaggatcaccaagcgcaaatcaagattgaattccggggattgggcagcgaacccggccaggaggaggatggtttcgccctccaaaaaggtgcctatgaaaagcgccaaatacccgtactgggcaattaattccttcatgaattcgatggacatgaaacagcgcccccgtcatggctccccacttggcgggagcgtggttttgacttgcgagaagtatgcgcttcctgcgtctgtgtccaccggttgccccggggaaatcatgacgttgcgcaacatccgtggaatcacttgaaatgggcagcatcctctgccatcatgggccacgatcaaccgttaccaaagattatgacgcactttagcgacatcattgcccaaaacgttgtcgaaagcctgccggtgggcctgctcatcgtggaccatgccggggccttcaccacggtcaatccggctgcggcaaccattttgggttactccaggcaacagttgctcggacgcggctggggcgatttgttttttgaaaacgaggccaacgcccggttcaatcagatcgtcatggacgtcattcaaaacgagttggtgggcctgtgccgggtcgtgccgtacgccgccccggacggcagactgctcgaactctccatcaccagttcctatctttccgcggacagcaacaccgccggcgtggtggtcattttgcatgacatcacagaactctcccgaatgcagcgccgcgagaccgacatgctcaaggaggtcaaccggatccagcaggaaaaaatccgcggactcaacaaactggccgcctcggtggctcaccaaatccgcaatccggcctttgccatcggcggcttcgcctcgcgcctggcccgccaactcgcaagcctgggcatagactcctcctacccgggcatcattcttgacgaggccaaacgcctggaaaccctggtgcgcaccgtgggccggtttgccgccctgggtccggcccggccccaaccggtccggctggccgaggtggcggatcaggccatgaagctggcccagaccctggttcccggcccggcggccgatgccgtctggcgcttcgagttgccggaggttcaactcgtggtcgaccgggaccagatcgcaagcgccctggccgaactctttcgcaacagcctggaatgcgccgccccccgtcccgtgaccatcggcctagccgccgccgccacgggcgaacgcctggaactggccgtgaccgacgacggccccggcatcagtccggctgacgcgccccacatcttcgatcccttcttttccggtcggcccgataaggccggcatgggcctgaccctggcccaggaaatcgtgctcgaacacaacggcagcctgacgctggacgccggatatgccggcggcgccaagtttgttctgaccattccgcgttttccaagccacctcatgtcccgcctggacgagccgggccatgccttgggcgtctgacgtctcccggccttgtccttggcgatgattccggctagtggtcaacagcgtcctgcctcgaacacccaaacttccctcaggaaccatcttcgaacaccgcttatggagattgtggtcaacatctccgacatgaaggtcaccaaccgcgccagggacgttctcgtcacccatgccctgggttcgtgcttgggcctggccgcctatgatccggtggccggcgtggccggactcatccattgcctgctgcccctgtcccgggacggcaaagtcccggccaaaaatcccttcatgtacgtcaacaccggcatccctcagatgatccgaaccatgtacgggcgcggcgcgacccgggagcacctggtgctcaaggccgccggctgcggccgaatgatgcatatctccaaccagttcgacaccggggccagcaatatcgcggcgctcaaaaagctgttgcaggtcaacgaaatgcgcctttcggccgaggatgtgggcggcaccattccgcgaaccatgcgccttttcgcggacacgggccggatcctgatctcatcgtgcgggaggtcctgggaattatgagccgacgcgaggaaattcttcaaaaggccatggccatccccaacatgcccatgccggtgcaaaaggtgctggcctacattggcaatgccgacgccgacctgcgccagctggccaagatcatcgaattcgacccggggctgacggtcaatgtcctgcgcatggccaattccgcgtttttcggcggcggaaccaaggtgtccacggtcaaggaagcgctcatgcgcctgggccttgggcgtctctaccagctcgtcatagcctcgggcgtagcccccctggcccggttcgccatcaagggctacggcctgcgtcccggggaactcctcgaacattccgtggccgtggccgtggcctccgagactttggcccgcgaactgggtgtcgttgccccgccctatacctttacggccggtctgctcgtcaacatcggcaagaccgtcatgggctcgtttctggaagtcgatgccgcgcccatcctgaccctggcccacgaacggcaaatttccttcgagcaggccgaggaactcatccttggcatcaaccatgccgaactcggcgcgctgttgctcgaaaagtggggcattcccacgcccatcgtcaacgtggtgcgctaccgcctgcgccctgacgagagtcccgaacccgatcttgccctggacctcgtccatgttggcgacgtcatcgccaagatgaccggcatcggcatgggcatcgacggcctgcaatacgcgccgtccgaagccgccttcgcccgcctggacgtctcgccgcaacagatggaaaacgtcatggtcgccatccttgagcagatcgccgaggtacgcgacatcctcatggaaaacacgttgtaagcaggagttgcatgactcgatccgcccattccctgcgcacccgcgatctgggctacgcccagcgcgtctgcgtggccaaagccggcaaactcatgatgcagaccggccagcttgctccccgggcccgggtggggctggccgtgtccggcggtgtcgatagcctggtcatgctggccgtcatggccatccgtcggcgcatcgtgccctttcccgtggaattgatcctgctgcacttgaatcccggcttcgatccggaaaaccacagcccccttgccgaattgtgcgccgacctgggcgttcccgcccacatcgaggtcacggactatggtccgcgcgccttttccgaggaaaacaagaagaattccccgtgtttctactgcgcctggctgcgccgcaaacggctgttcgacctgtgcgcccgctataacctgagccacctagctttcggccacaacgccgacgatctggccgcaacgtttttcctgaatctcttccagaacggccgggtcgatggcctgtctggccgggaatcgtttttcagcggccgtctgacggtcatccggccgctgttgctggtggacaagcccaccatcatacgggcggccaaggcctgggaactgccggttttttccaacccctgccccatggccggcaaatccatgcgccatgaggccgagacctgggtccgcaccatctgcgccggcggcaagaagcgcggggtcaacctccaccacgccctaggccgctggcaactcggcaaggacgccctggccggccctgaaacggccccggacgcggccggcgaggcgtagcaggcagcatgtttcgccattaccagctcgttatcttccgcgaccaccacggcgcatatcgcaagctgcgctttcggggctggcttttcgcgctgatgctcctggccctggcggcggtggtggccggcgacgtttatcttgtgaaatattattataattataaacggatggagcgcgagctggccgaatgggaggcccggggtcaggaccagaacgcccagctcgtcagcctgtccgacaaggtcaaggccctggagaccgacctggcccgcatccgcgggttcgacgccaagctgcggcgcatggtcaatctcgatcaggagccccgggacgtgtcgccggggggcgaggaaaaagacttcgacaagaagtacctgccgctttaccgccaggagatgcttggccgaaagctccaccagttcctgggtgagctgcgcgatcagaccgccctggaactggcccggcagcaggagctggcgaccctggtcgaaaccgccgacgtgcgtctgaccgccctgccgaccagttggcccgtggccggctggatcgccgccccttttggcgaacgggtgtcgccctttaccggcaagaaggaattccacaaaggcatggacatcgccgcccccgtgggcacggaagtgaaggccccgggcgagggcacggtcgccttcgccggcgagaccgacgacggcggctttaccgtggtcatcgaccatcaaggcggcctgtccgcctctttcggccacatgcgcgatgtgctcgtgaccaagggccagaccgtggccaagggacaaatcatcggccatgtgggcgactccggacaggccagcgggccgcatctgcactacgaaacccgtctctacggcgtgcccgtcaaccccatgcgctacatcctggagtagcggccggaacttggtccagcttttgctaacctcccgccatggacctgttccactttaatccagccatggtcttcagttttctgctgaccttcatgcgactgagcgtcgtggtcttcatgctgcccttttacggggccacgcttattcccaacgtcgtcaaggcctcgttttgcctggtgttgtccatggcactgtggccgcgcctggcctttgccggcacggctttgccggccagtccctggaccatagggcttatgtttctcggcgaagtgctcatcgggcttatgctcgacatcctggtgcgcctgctgttttccgccgcccaagccgccggagccatcatgggcttttccatgggtttttccctcatgaacagcgtcgatcccatgaccggcgcatcagaatcgggtctgggccacctcatgagccaggtggccaccatgctctttttgtgcttaaatggtcatctctttctgctctccgccctggcccagagcttcgaaatggtgccgccgggggggctgctcatcaacgccgccgtgggcgaacacctcatcgtcttcaccggtcagttgttcgtcatggccatcaagattgccgcgcccatcctggcttccatctttcttgtcgatctggccctggccctggtggcccgggccgcgccgcagatgaacgtgctgttcatcggcttccccctcaaagtcagcgtgggttttttgttcatgaccatggtcttcgcggccatgaccgttgtcatcgagaatttccttctcgacctcgaacccatgttccggctggtgctcaaggcctcaagctgacgccgcaaaggggccgccatggccagagatcccagtaaaacagaaaaagccacccccaaacgggaaagcaaagcccgcgaaaaggggtcggtgccgcgcagtcaagaactgcccaaactcaccgtgctcatggccggcctattcaccgtgcgtttcaccctgggcaacatcaacgaacagctgcaagaggttttccgcacctttctcggcggccgcctggactttaccgccaccaccgacgacgtggccgcgctcatgtggagcctgtcggccaagctggccatcatgcttctccccctgctgctggtcatggccgtggtcgcgttcgtcacccagcgcctccaggtcggcgaggtctggcggcccaaaatctttgaaccggacttcagcaacatcgtcaatcccatgcgaggactgcagcgcctgctgatcagcgcccaaaccctcgtgaatttggccaaacaaacggccatggccttcgccatttccttggtgccgtatctgattcttcgcaagcggttcaacgaattcctgccgttgttctatcagagcgtagacaacattgcgctatttcttttggacaatggctttgacatggtgctgtacaccttattgcccatgttcgtcatcgccatactagatgtatggtacacacgctgggattatgcagaaaacctgaaaatgacaaaagatgaagtcaaggacgagcacaagcaatcttttggtgaccctcacgtcaagcagcaacaaaagcgcaagatgatggaagtcatgcagcgccgaatgcttcaggacgtgccaaaggctgacgttgtcatcaccaacccgacccacattgcctgcgctctgcgctacaatccgctcgaatcgcctgcccccatgctcctggccaagggggccgacttcatggccgagaagatcaaggacatcgccaaggagcacaaagtgcccatccgcgaaaacaagcccttggcacaggccttgtataagaacgtggaaatcggccaggtcatccccgaggacctctaccaggcggtcgcctcgatcctggcccaactcgacaagttccggcgtttcaaccgtccgcgctgaggcgacggcgggccgaaaagggtgtcaaaatcatggcgaaagcagcccaagcaccggtccagttcaattacgaacggttcaccaagcaaggcgacatcatgctggccgccggcgtggtggtcatcctgttcgtcatgctggtccccatcccgccggcctttatcgacctcatgctcaccttctccatttccataagcctggtggttctggtcacgagcatgttcatgggctcgccgctggaattttccatctacccgaccctgctcctggtcaccaccctgcttcgcctgtccatgaacgtggcctccacccgtttgattctcctccacggcgacgagggcccatcggcggccggacacgtcatccaggcctttggccagttcgtggtcggcggcaactacgtggtcggctgcgtcatctttttggtccttttcgccatcaacaaaaaggtcatcgtggccggcaccacccgcatcgccgaggtggctgcccggttcaccctcgacgccatgcccggcaagcagatggccattgaagccgacctcaacgccggactgatcaacgaaaagcaggccaccgaacgccgcgacgccatccgcaaggaggccgacttctacggcgccatggatggcgcaggcaagttcgtctccggagacgtcaccgccaccatcatcatcacggccatcaacatcttcggcggctttttcatcggcgtgctgcaaaagggcatgaattggaaggacgccgcccagacctacaccctgttgaccatcggcgacggcctggtctccatcatcccgtccatcatcatctccacctcggccggcctcatcgtctcccgagccgcggccgaagccaagatgggcgaagaattcatggcccagctgaccttccacccgcgcgccctgaggctggtctcgggaatgctgttcctgttcgccatcgtgcccgggttgccgaccttccccttcttggccatggccgtcctgctctttgtggtggcccggctgtccggcaagcagcaggagctgctccagggacaggccgccgaacaggagaaaaagccggccccggaactcgaaacccccgaagaggtccagaccctgctgccgctggacgccctggaactcgaagtcggctacggcctcattcccctggtcgacgaggagcaaaacggcaacctgctggcccgcatccgctccatccgccgccagttcgccctggacatgggcgtggtcattccctcgttgcacctgcgcgacaatctccagctgcgccccggccagtacgtggtgctcatcaagggcaacgaggtggcctcggccgagatcctcatcgaccactacctggccatggatccgggcgacgccaagcaccgcatccagggcgtggaaacgcgggaaccggccttcaacctgccggccctgtgggtgcccgagctgcacaaggaagaagccatgttggccggctacaccgtggtcgatccggccaccgtcatcgccacccatttgacggaggtcttcaagcgccacctgcacgaattcctgggccgccaggaagtgcaaaccctgcttgagaccctgtccaagcgcgcccccaaggtcgtggaggaactggtgcccggagccatgaacctgggtggtgtgcaaaaggtgctgcaaaacctcgtgcgcgaaggcgtgtccatccgcgatctgctgaccgtggccgaaaccatggccgactacgccggctcggtcaaagacccggaccagctcacggaatacgtccgctcccgcatgggccgcaccatcgtgaagccgtatctgaccggcgaaggggccctgcccatcatgacgttggctcccaaggtcgaaggcgcggtccaggaaagcgtgcgccagaccgaccacggcgcctacctggccatggaacccggcctggcccagcgcatcatccaggccatccagaaggccatggacaaggccatgctcggcgacggccagccggtgcttttgacctcgcccctggtgcggccgcacctggcccagctgctctcgcggttcatccccaatctgccggtcatctcccaggccgagattccggccgagatcaagctgcaatccattgccaacataggactgaccaatgcgggttaagacctttcgcggcgaaaacatggcggctgccctcgccatgatccgccaggaactcggcaaggatgccgtgatcctcggcacccagagcgtgcgcgaggacggcaagaccctttgcgaggtcatggccgccttggaatatccggacaaggaagcgccgccgcggccggctccggccgtgccggcccaatccgccgcgcccaaggggcgtcccggcaacggcgctgcccccaagcccgggggcaaggtcgcggtcaaacccgccgccgcaaccatgccgacttccccgcagccggccgactggaaccgggaatggaccgagatcaaggggcatctgctggcgctcatgcgcccccgcctggacctttcctccctgaccccgcgccagcgcctggccctggaatacctggaacgcgagggagtggacgaggctaccattttggcgctgtaccgctccatcgtggaacgcggcgaggatgccgtcattccggccctgtcgcgcctggtcgccgtcaaaccgctgacgccggcgctgtggcccgccaccgcccatatgttcatcggcccaagcggcgtgggcaagaccaccatcttgctgcgtctggccctggacgccaaacggcgggcaaaggacggcccggtgaccgtggtcaacgccgacgccggacgcggcaagggccggctgatgttgcgccactacgccgaattgtccggcttgaattacgccgaggccgacggtccggaagcctttggccggttcctggacggcgcggccaagggggaggcggtcttcatcgacacgccaagtctgacccacggcggcggtcctgaggcctggctgacccagtggggcctgaccggacgtgaccaactggccgcccatctggtgctgtctcccacctattccagcgcccagtccgagcactatcttcgcctggcgcgctgcgagcatcttgccagcatcatctggacgaagctcgacgaagcctgtaactacggaagccttgtcaatatggcccacgcctccggcctgccggtctcggccctgacctatgggccggaactcaccggcggcatggcggcggcctcgggcaaggcgctctggaaactgctgttcaaacgccagctgcccggtcaatacccggacgccgacgccgcagcctgaggacgacccatgtctgaccgcacatcctccgcccgcccgcccgccggcctcggcccggaactgccccttgtcctgtccgtgacctcgggcaagggcggcgtcggcaaaaccaacctgtccgttaatctggcctactgcctgtccaagatgggccgcaaggtggtgctgctcgacgccgacctggggctggccaacgtggacatccttttgggtctggctcccaagatgaatttgttccacctcttccacgaaggcgtggaactgcgccaggtccttttggagacgccctttggcttttccatcctgccggcttcctcgggcataagcgacatgctggccctgtccacgggacaaaagctcgatctactggaggccatggactaccttgagggcaagatcaattatttgattgtggacacgggcgcgggaatcaatgataatgtcatatatttcaatctggccgcccgcgagcgcctgctggtactgaccaccgagccgacctcgctgaccgacgcttacgcgctgatcaaggtcatgcacttaaaccacgacgtacaccgtttccgggtcgtggtgaacatggccccgagcgtcaaggcggccaaggcggtttttgccaagctttacgccgcctgcgaccattttctttcgggcatctccctagacttcacggggtatgtgcccgccgatgcggccgtcaagaacgcggtgatccggcaaaaaccgttttgccacttgaccccggactcgccggccgccaaaaaggtcatggatctggcccatgtgatcgactcctgggaagtggatgccaagctcgatggaaacatcaaattcttctggaaaaagctcctcttccaggaacagcccctggcttaagctcgagtccggggcgtttcgatgggatgattttgatgcgcgcgatcggcaggagatcgtgcgccattactcgcccaagatcaaaatcgtggccagtcggctgcgggccaagctgccgccgtcggtggagctaaacgaactcatcagcgctggggccatgggcctgctggaagcgctgggccggtttcggcccgaactgggcatcaaattcgagacctatgccgagtcgcgcatcaaaggggccatgctcgacgatctgcgccgcatggactggttttcccggggccagcgccagcgggtgcgcaccctggaagaggccagccggcgcatcgaaaacgattccggcgggccggccagtctggaacaactggccgaagccacggggctgaccgagcgcgaagtgtccatgggcctggaagcgctgcaaaaccagctgtgcctgagccttgacgccatcaccgagaacatctcttcctaccagaagaaccagctcgaaaacgagccatataaatcggcggaattcaaggaactcgtcgataagctggcatcgcttatcgatgatttgactccccgggaaaagctggtattatcactctattacggtgaggaattgaacatgcgggagacttcggaagtcatgggcatcaccgaaggccgcgtctcccaactgcattcccaggccctggcccggttgcggcagaagttcaagtcccagtacaacattgagcagcattgacgctgtccggggcacgccgaggcggccgcgtccagccggccaagagccggaacaagcggatgttccaaggcgacgagtgaagcgagcgagacaaggagacgagccatggccgccaataaggaaatgcgcattctggtcgtagacgacttctccaccatgcgccgaatcatcaaaaacatcctgcgccagttgggcttcaacaacatcctcgaggccgacgacggcagcacggcctgggaaacgctcaacaaggacaagatcgacttcatcatctccgactggaacatgcccaagatgcccggcatcgaactgttgcgcaaggtgcggggcagcgaagagttcgccaacctgcccttcctcatggtcacggccgaagcccagcaggagaacatcatcgaggctgtccaggccaaggtgtccaactacatcgtcaagcccttcaccgccgagaccctcggccagaagatcgacaagatattcgacaaatagcctttccggccgacaaggcggccgtctgctccgggcagacggccgccgcctaagggccgggcttcggcccgcgcccatgcccatcaaggccgtgccgacgccacagggcgtccccttcccgccgtccggttgacgaggcccgaccatggttgacgacgacagcctcgacgcccccattaaagccaaactggacgactcggaactctccgacgatctccccaaggcgttgcaaaaggtcgatctcgacctcgacgacgccccattcctcgaagacgaacccgaagagacaccgccgcccgccgaagagaccggaccgggcgacgccgcagccacggaagcgccggccaagcccaaaaacaagaaaaagctcttgatcctgattgggcttgtcgtgctgctgctgggcggcggcgcggccgcctatttcctgttgctcaaaaaaccggccgctccgcctcccccgcctccagtggaagcgccccacgaggaggagccgcctcccccgccgccgcctcccccgccgccggaaccgcccgcgcccaagccggaaatcgtcctgaccatggaccctttcctggtcgaactgccggacaaggccggtcgcagccgctttctgtccatccgtttctcggcggccaccaccgaacacgccgccgagctcgaattcaagcgcaaccgcattgtggtgcgcgacgccgtgtattattatctcaaaaacaagagcctggagttcttgacggacaagaacaacaccgaggccctcaaaaaggacgtgctgtcggtcatcaaccagttcatcggcccccaagccctggataacctgattatcgaggactatctggtgaaatgagatgcccatcgatctgaccaccgtcattcaagccgtgccctatgtgcaaaacgtggcccacgccgaactggtgagtcccgaggcccagcttgcggcttcccaggccctgacccagcaagccctggccgagcagaacaagcagacccagcgcattgagaagcaggacgaaatggattccgtgcgtgacgaggaaaaacggcggggggccggccagccgcgccagcgccgggccagggcggcccagcccgagccggacgaggaagcgacccaggccagcaaccccacgccctttgccggccacatcatcaatatgaaggtatagcacaggctgcggcgtgcgcatggtcccgggagccggccgaccagtgtggggccgacgcccaggtcggccagccgacgcatcttgcagacaagcgactgtgatagagttttgtttcaaacgttttgccccggaccccaccacccatgaacggctattccacactggtcatctttctcacggtcagcgaactggccttgctgcttctggtcgtgctgtttttctcgcgcctgcgccggtccgaagaattgctggcccggctgcaaaaaaaccaggacgcgctgctcaaaaagctcgacttcaacgccaaactcgaacaggagctggtgggaagtttccagcgccgccaagccgagctggccgatctggaccagaagctggaggagcgcagccggcagttggaaaagcttgtgcgcaaggccgaggaattcacccgctccccggatttcctgcgccaagtcatcgtcaacggcgcgcgccggggccagtcgccccaggccctggccaaggccacggggctgtccctggatgaagtggaattgattttgacgcgccagggctagggctttaactcccgccccttgagcggcgcgttgtcatgcaccttggcgtccttgggcggggtgaaggcgaacaggctgtctgacagcttggggtcggccacgatcttggccagcttcaaatcgttggtgttggcgtagaaatcctgaatgtagatccgcacaatcatgtcggtggtggtgtccacccagaccttggccatgaccaggccgggctcgggttcgcgaggaacgagcagcagcgccgcttcgcttgggccagcctcgtccttggccgccgagaccacgaaatcctcggtcagattggccttgccggtcagaaaccgcagcatggtcttggagttgatgatctcctccacggcatagcggtaggcttccttgtcctcctcgaaataatcccacacggcgtccttgccgacaatgagcaactccttttcgggcttcaccgtctcccagcgcaccagcgtcggctttttaaagacaaaagaccccgagcgttgctcggtttcgccgctggccgcattgcgaatggcctggctgaactcggcggaaaaggcggtcagggccgcgtatttcttctggatacgcccggccagctgggccgggtcggcggtctgggcggcttgggccgtctgggccaagcccaggatcaaggtgaggacaaggaggacatgccgcatggcgttgctcgctttgccgcccggacgggccttggcggcggatgcccggcccgggagacgggctgaggtcgcgtcttgcggaccgggcgtgaatacgggttacgtgggaggacaatgccgggcggccagccgggcgcgaccggcctagccgctaatccttggttttgatgaccgaacggggcttgctgccttcctgggggccaagcaggccgtcgcgctccatctgctcgatgaaccgggcggcccggttgaagccgatgcggaagcgccgctgaatgagcgaaatggaggccttgccctgctccatgacgaagtccacggcttggggatagacggcgtcggaggtgacctcatcgccgccttcgccgataaagtccccgcccccgccgccgtcgccgcccttttgccattcggcgaagtcgagcttatagctgggcttggcccggctcttccagaactccaccaccgctgccgtctcctcgtccgagacaaaggccccgtgcatgcgcacggtcttgccgccgctgggcttgaacagcatgtcgccccggcccagcagatattccgcgcccacggcgtcgaggatggtgcgcgagtcgtgcttgctggtcacctggaacgaaatgcgggtggggaagttggccttgataagccccgtgaccacgtcgacgctgggccgctgggtggccaggatgaggtggatgccggcggcccgggccagctgggccaggcgcacgatgctcacttccacttccttggccgccgtcatcatgagatcggccagctcgtcgatgacgatgacgagatagggcagcggttcgaggtcaatcagctccgggtcgcgggcgtcgccgagtttggcgagcttttcgttgtagccggcgatgttgcgaacgccgagcagcgccatggcctcgtagcgccggtccatctcggccacggcccagtccagggccgacttggccatggccgtctcggtgaccaccggatgcaccagatggggaaggtcgttgtagaccgaaagctcgatgcgcttgggatcgaccaggagcagcttcacctcgtcaggtgtggccttatagaggatggaaagcaggatgccgttgatgcacacgctcttgccgctgccggtggcgccggccacgagcagatgcggcatccgggccagatcggccacatggggccggccctggatgtccttgccgatagccagggtcaggcgcgattccgaagcccggaaggcgtcggcgtccaggatgtcgcgaaaatagacggtctggcgcttggcgttgggaatctcgacgcccacagtgtccttgccgggaatcggatcgatgcgcacggccagggccttcatggccagggcgagatccacggacagcccgacgatgcggcttatcttgacgcccggcgccggcttgacctcgaacatggtgaccacgggccccggcgccacccgcatgacctcgccctggatgccgaagtcgttgaggcagctgatgaggctggcggcctgggaacgacagatttccggatcgaccggcacggcctcggcggccgacggcacggacaaaagcgtcaggggcggcagctcgtgggcggccgaggcggcggcccggccggcgctcttggcctgcttggcggtcatggccgacggcggggtcgtaggcgcgaaaagcggctcggccggctcggaagccttggtcggagacgggaccggcggcgcggcctggggcgcttcccgggccggttcggcgaccgctttggccgcctctttggcgggcggcgcgccggtcacctgctccaccacggcgtccaggaaccggtccacggcctcctcggacgcgtcgtcgggagccggactggaagcggccttgggcttggccggcttttcgattttggccggtttgggcgggcgcgcgggcttgtcggccgggccggcttcggcggcggcctcggccgcggtctcgcgggccatggcccggcgcacgcgccaggcgtcccaggcgtcgcccaggcggccgaactgttcgcccagggcggcggccaggggccgccagaaattgtcgagggtcaggccgaaggtcagctgcgccccggcgatacagccgaaaaggagcagcgagaccacgccaaaaacgctcaggtagcggtcgaggaatccgtagagcaaggctcccagctggcccgagccatgaacctggccgacagtcgggctgccgacgggagaggcgaaaaagaccagcaggacgacggcgaagatggccagccccaggcggcggcgcaggggcaaagccaagcgtggggccagaccgcgcgcgccaagccaaaccatgccgatgggaaccagaaagccccagacgcccagggtctcggcaagcagaccgccccaataggcccccaccagcccggccttgttggccacgccgtggcgggccgagacggactggttgaagcccgggtcgcccgcattgtaggaatacagggcaaccgccgtaaaggcggccaggaacagcgcccccagccccgccagttccctggtgaggcgaaagctgccgtccccggccttgacgtctttattcccggccaatgtagtcgcccgaacgggtgtccactttgatcctgtcgccgatgttcacaaaaagcggcacgttgacggtgatgccggtttcgagctgggccggcttggtggcgccgctgacggtgtcgcccttgaccccgggttcggtctcggcaacctggagcaccaccgaagccggcaggtcgatgtccaggggctggcccttgtagaggagcatcttcagttccatgccgtccttgaggtaaccgcccttctcgccgagctgggccgcgccggcatgcatctgctcgtagctctccatgtccatgaagacgaagtcctcggactcgcggtagaggtactgcatgtccttggattcgaggtcgggcttgaccatcttctcgcccgagcgaaacgtattttccaccacgcggccgttgatcatgttcttaagcttggtgcggatgaacgcgccgcccttgccgggcttgacgtggaggaagtccacgatttcgtagggcacgccatccatttcaatcttgaggccgcgacggaagtcggtcgtggaaagcattgtatctccttagatataattgggattctcggttatttgtcgccacagggcgaccacggccagggcgtagctggtgacgccaaagccggcgatgcagccgatgcagttcttgccgatgaggcttttgtgcctaagcggctcgtcggtacgggcgaagatgttggaaatatgcacctcgacgcaggggatgccgatccaggccaggcaatcggccagggccaggctggtgtgggtataggccccggcgttgagcacaatgccgtccaggccgtccttccaggcctgctccaggcggtcgatgcaatgcccttcgctgttggcctgatggaattgcagctccaatcgctcggcttggggacccaggatgtcggccaccagttgcggcagatcctcgatggtgcggctgccgtagatttccggctggcgctggccgatgaaaccaaggttggggccgtttaaaaccagaattttgattttgcgcatggtttcttcctttggcttgcccggactcccggccttgacggacgcttcctggccggtcacaacccagccatgaacgccaatgaccgcatacagacggacctgggcctgacgcttttgtccacggcctacctttccaaccagctgccgaccctggacgcgccccagatcgccctggccggccggtccaacgtcggcaaatccacgctgatcaactgcctggccgggcgcaaatccctggccaagaccagcgccaccccgggcaagacccgcagcctcaacttctatatggccgaaacccagggctattgcctggtggatctgcccggctacggctacgcccgctgctccaaggaggagcgggacaaatgggccaagctcatcgaggcctatctggccaccaccaagaccctgcgggccgtgacggcgcttatcgactgccgactgccgccccagcgcctggacatggaactggtttcctggctgcgctcccggcgcattccggtgctggtggccctgaccaaggccgaaaaagtgccccagcgcgaccgggaggcccggaaaaaagagtggcgggagctcgcgcaacccgccttcccgcccgtggtgttctccggcaaaaccggtcttggccgggaggcgctttgccgggtgttcgccgaggccgcgcttacggccggggctcctcccgctccttgaaaaaaccgcttaaaaacgtggcgtccttggggctcaggttgaactgcatggctgcggcgtcaatgagcgcgccgaccggctttccggtcagttggcgttgctcgtcgatccatgtgacggcgcgccgcagcagttcgccctggggcatgatcgtggccatctcgcctccttgctcgggtccagtgcatacacgagcccgggccggcttgcaacttgcccggcctttggatagacccggccccacatctcgccttgaggagacacccttcccatgaccgaatccctggccgccgtggtcctcggcatcgtcgagggcgcaaccgaatttctgcccgtatcctccaccggccacctgattttggtcggccacctcatcgggtttacgggcgaaaaagccgacagtttcgacgtcatcatccagctcggagccattttggccgtggtgtgcctgtattggcggcgcttctggtggctggtgtcgcccaaaccccaccacgctttttccggcattcgcggactgtggatgctgtttctgacttcgttgccggccggactcattggccttgtcgcccgcaaatccatcaaggcctatctgttcaatccctggagcgtggccctggccctttccgtgggtgcggtcatgatctttttggtggaacagcgaaagacccgcgaccgctactacagcctggacgagatgacgccgggcctggccctcggcatcggctgcttccagtgtctgtcgctatggccgggattttcccgctcggcggccaccatcatgggcgggatgctgcttggagccaagcgcagcctggccgcggaatattcgttcatcggcgcggtgccgctcatgtttgcagccacgctgtacgatttctacaagagcgcccatctcttttccgccgacgacctgggcgtgctcggcatcggcttcgtggtgtcctttgtttcggcccttatcgcggtgaaggcgtttatcgtgctggtccagcgaattacgctgcgcccttttgcctggtaccggctggcgttggcggcggcggtgttttttttctggccgaaatgagccggaccgcaaaaaaacgcttgccaagccaccccggttccgctacatacccgcttctgcgctgcatgacggtttggcgaggtagctcagatggttagagcatgcggctcatatccgcagtgtcgggggttcaattccctccctcgctaccaatagttgaagggatcggtcctaagtgtccggtcccttttttcttttctgggcacagagttacctctatcctccaaggacagccatcccaaggccagtggtacaaaatgctggtccaaactcctcccgtcaggggatgttatggctgtttcctcatacttggttcaacgcggatcatccttccacttccgtgccgtcgtcccgttagaccttcgcgctcgtctgggccgaactgagcttagggtttccctcgggtctggacgggttcgggactcaaaagataaggcgttgttcctggctgctttcgttcgacgcatgatgagggatatccgaggtggagccatggcagaactgaccagtgaagaaatctcaacgattgtaagggacgaatttcgccgaatcctagaagaggacaagcgcagcagaaaacagcttccgggacagtacacattcgaggtccgctgggacttgggcgaaaagctaaaagaggactggcgtagaacagatgatgtttgccaattggacaaactgagtacgcaagaggcagataagaaagttcgaaatatgctctataacgaagaatgggcagagtttgcgaaaccagtaatcgaacttgccaagcgacatggatttgacataagttccgacatccctacaacaaatgagatgtgcttcgaatacgctcatgctatggttgaggtgctttcggcgatacgcaagagggaaaatggacacacggattttacgccagaagtgttcctggacgatcaacccaaacctgaacaacagaatccaaacggcttactacaagcaaaggacgacaggaagctatcaacactgatacgtgagtacagcgacgagaagaagcgccacggctggactgagaggtcagagcgcaccataatggagcgccttaactctcttacagaacttatgggagatgttgagctagaaaaggtagaccatgattttgcgttcaagtttcgaaaactgttgatggacaagcccaaaaagcgccagtcaaaacaagcaaaagcgtcaggaataacagaagctattgccgttgggacggtaaacaacattattacagacatagcagcaatgtttaagtgggcaaaaaaaagaagatggataacagataactactttgaagaaatgaccgtgagcgataagacgccagcacacttaaagaagcagtccttcaccaaggaagaactctcaactgtattcgggagtaactttttgcctgcctgcaagaacatcccgtggcgcttttggattcctgttcttggactttttaccggagcgcgccttgatgaaattgcacaagccaaggttgatgacgtgcgggaaatagacgggatatggtgtctcgttgtggaatcatctgaagacaagtcagtgaagactgcaagtggaaacagaaacattcccttacatccattcattgtccatggactacggttcttatcattcgtcaaccaacagcgagcaaacggtgaaacggaattgttccccggacttaagcgtgtccaaggccggaaaggtcactacgcaagcaagtggttcggagaatacagagacaagctgaacataccaaagacgaagacactacacagcttgcgaaagaactttacaaaaaacctcgcaatacatgacgttccagcaaacatgatcaagcgccttgacggacacagcctatctaatgacgtcacggaacatcactacatacaagacatccccgtctacaaactggctgagtacataaaaaaacttaactacggacttgatttatcacacttagaaggatctaaatttgttgtcggcttgtgaattacatgcctgccgaggaggttcccgcctataggacatacggccgagcaacggaccagttcgcatcatagggagccggcagtgggtgggtatacgggtgggtgggggcagtgataagcatgcttagatgagactcattctcagcaggggtcccactaggtcagatcgtttcatttgcaactacacagccaggtgaaaggaaaaggccgacgctcagtttcagtgagtgccggcctgtatcgtttcagggagttgttccctggttgtctcgtgggtcactaatccttcgatgccctgaccctggacatcaacagcgaaacattcggcccggtccaaggcttccccgtggctgttttgtgtcccctggcatttaggaaaccggccacctcattccagggtctgcgcttgccggccttattcagcctgcggagcataccaatctctgcgatgataccagggttcagttcttgtgtggacttccttccctcacacttcccctgtctcgccttaacccttcgccttgctgcccgcaactttagtaccaacatctgcttatcgtactctgcgattgcacccaacacttgacgtacaagcttgcgcgtcggatcattgctcaacaggtctgctccttcgacggcggatatcaattcaactccatgctgttggaagtcccttatgattccttcctgcaccataagatcacgtgcaagacgatcaagcttttcgatgatgacggtcctcacgccatgcccgttctgctccaagctgaccatcatctctgccagggctggacgatcttccacggtcccgcttacgcctccgtccatgaagacctcgaccacttccagcccatgagccttggcgtattctcggatcgcaagctcctggcgctctggtccgtcaccgtccacctgacccttaccgctcacgcgaacgtacccaaaagcccggttcatgtgccacctccaattcagcctggatgtagacaacataagggctagctggtcaccagtcaatcatattctgtagaaattgtctgacagaaaaaccgatccttcccatatcccaggcctgccagcaaggatcacaggagcggaccttaacaaagaggatatccgaccactgaactgtgaaataagggcgtgagtcaaccagggagcacccaaggtcatggtgcttcaaagatcgtggcgggagcacaaccgagaagggccttatcatactcgcgccgaagcctttctctatctccgtgcgtgctctgctccagcacgtactcgaagctgctccttgatgttccaaacacttcccatggcctgcactcttcatactggtcggtggtcatccagaacagacggtacacaacatctacagggctttggttcatgactacctctgcatcgcaataatatgccccaccatggggaggcacgatggggcacaggcgggagtgagccttctaagaagaggggacacacagggctaggacttaaacgatttcttccgctcccataagcgcatctcctccatcttcttgcgtcgttcacgctgcaaggacttggcaaccaacggagcacccttcttgaaaccgtacttggctcggtattcctccggggtcaggttgtgcgccaccaagtgcttcttcgtgaggaccttgaagaccttgccgcattcaagacaagtgacagagcggtccttgaccgagtccttcgggttcatgattacggcggcctcttgcgcgtccggctctccctggctggacatcacaaacgatatcccaccggatacagactggatcatgctaacgatctcggcttcagtcatcgcgcgagttttggcctgtgctgtgacgatctctatggctgatttcagactatcttccatgtgtcctcctggttattccatcaacatttacaacacaaattttgctgatgcaagaactaatcaagacacaactaccaacaggcctaccaccaagaccttaaaatcgtcagaacgaagagccagcaccatacgggaacagtccatcagcctgcccggaataatcacaagcactgaaaacaatgcggcgtgatatcccctctattcctgtctggatatcattggctcggcatccactgaacccctcagcattcgggagggtcagaccgtgttctacctagcttaccagccgaaacaataaatattcgcaggttccccaagaactgcggcgggaaacaccagggatcttgtaagtactgtattggagccgtgttctggggaacaagaccgccgataggcgggcatcttcttgtcggcgttacaggcaaaaacctgtcacacgtgtcacaaaccctcagaaccggcataaacagtatattctaactgtgcatagctgtcacaactccagtaacaaccacagtcacaagtaacaaaaaaggaagagggcatcctaagcagagttcatgactttgtgactccactttgggcaccctctccctggagttgtcacaatacaaacctaatgttcatgcagctttatcaccacttgtgacttcgtgactggaattacctgttggtcctgcgtataatccacgtcctacacgactcaactctccgtcattaaccattctgcataaagtctgacggatagagtcttctggcttctttagcttcagcgacaactctttgcacttcattggagatccactttcaaccaataagtctaggatctcttgccgctcacgagacacctgaagcaattttgagtcatcactgattgaccacacccccccagacgatattgtcattgaaagctgcattgcttcaatgtcgcgactctgtgtgtatagaacacctctcggttcgctagattctttttcaagaatccaggcattgtctacagtagcaaatatgcccgtcgatcctaagatgttatcaaacctatcgccgtcccccgcttgctgcttcctcgtgtgatgtacgaccaaaatagcaaccccatgatcatcagcgattgccttcaatcgcgaaagtgacttcacctccctagcatatcctccatcgttctgtttatgtcctgcatcttgctcgtccatccgaaacttgcctagagtatcgataactacaagttttacggatggcttcgatttcagaaagtcccgcagatcgctctctttggtcccgcccgttaatggcgaagatttagggggagaagtgcagatatgcaggcctgcaggaattacatcatcctcgccaaacattccacggactctgttttgaagtctgcgttcaccgtcttccagggatagaaaaaggacgtctgcctgttgtacagagattttccccaaaacaatcccgccagcagcaacgccacaggctaatgataaggctaggaatgacttacaagtcttcggtctaccagccaggatagttaggcctactggcaataggtcagggataacgaactgttgctgtggaaatgttttggacatcagatctctcgctgtgacagtaagtagcacttttcatcctccgctcctctagcagtagtattcatcccgcccgattagctggaggagtagcagcgcatcagtggtggccaaaccgagatgtcgggcgggagtggagagcagaccagtataatgcagcagaagactgctatcaagatgtcgtactgtaaaaagtaactagagaactaggagacatatccttcagataacatccacaattcgtctggtgagttagcaggattcgtcaagttgtctttttttgttcgtggtcctttttatcggaccacgaccgcccttttatagctccacggttccgaccattttcaagggcgcattaggcatcccaacagcaacagtcagtacgccatgtcctaatggatatcctgtgaaaatagccagttaacagggtgcacttgagaacccgtcagaattgacgtttccgatattctggcggactgacagactgattttcccacaatgtctccaaaaacggcctccctggactcctggaactctgcaaaaacatacgttttcacagaagcgacttttacaagctgacctagagttcatcttcaacagttgaattaaaaaactcttacaaaaccatagaggatttttacaaggagacacacgcattggcaaagttttccagacgatctgatgaccatcatgggacagaccatatccaccaacgaaaagggtctcgtgagcctgaccgatctgtggaaagcgggtggaggcgaagaccgtaaccgcccgaaagagtggttatcgttcaagggcaatcaggagtttattcaggagcttgcaaaaggggggaatcccacccttttcgttcaggtgaaacccggacgcaatggcggaactttcgctcactggcagatcgctcttgcctacgcgaagtacctgtccccgaagctccacatggccgtcaacgacatttacatgcgttacaagatggccgacccgaagctggccgtggaagtggcagggtgacctggggcttgtcagtggttcaggccggtggtacacacatcatcgtaaacagaggcactttggctgctccttggaaataaaagcgaacgatttcatgcttttgaatgttcgcccggccgattccctccctcgctaccaatagttgataggccccaggcgaaagtccggggccttattttttgcgatattcccgccccttggcctgctcccggagccggcaagacacaaagccgttgcgcaaaatcaccgcaccggagtattgctggagaaactcccaggagggactccatgaaacgcgttacgccacttgccgccggcctgctcttttgcctgctggccctggcgaccgtctgtcaggccggcgcttccgatccgctgttcattaacctgaccagcgacgacggccaccgttcgctcatggccatcagctttggccaaaaccagttgcagcggggccaccccctgaccgtctatctcaatgacaaagcggtgcgtatcgccagcaagaagcacggcgaggcttttgccgagcagcaggcgctgctccagcagatcgtggccaagggcggcacggtgctggtttgccccatgtgcagccagaaatacggcgtagcggagagcgacttccttgacggcgtaaaactcaccaacccggacacgaccggcgcggcgctgtttacggacaatacccggacgctctcctggtaactcgcggcgggcgcagagacgcttttcagccgggctccattccccggccgctcctgtcgcccgccccaatgagaacgccaagattttcggacatctattattataaattcacgattctcaacagccccacacgacgagaaccgaagggtcagccgccaaccggcaggcgttcgccaagtccgccgctcagccctgaaccttcattgatgccggcgctccccgtggtaccagccgcagcgcctttctgttcttctttcatcaattgggcgttgagcgttaccaacgtcgctgtgagttggtttatttcagacgtgatgatttttacttcaggatcttgcgagccttcggaagcctcggcctgggcggcatctctttcatcagtgtttgcctccgattcaggtgcgaccgccttctcttcgccatcacttgagttctttttctttgccgtcgcagcagccaagcgcgaatttgctttgtcgagctgttctttcactttttgtatctgtttcaataacatctcgcgggtactcgtcgtttcttcctcttttgtttcttcttctgttccctgcgcctggcttgaaacggcgctgccagatgtcgtttcggcagattgctgctgcttttgacgagctgcttcggaaatttcaaccgtgtcggtgtttcttgacgtttcgctgtccgtttgccccaccgtggcgacagcgctctgggaaaccgttgtctgcgataacttcctggaatcttgataggcttttatcgaatcgctcgtcattgcccctgttccattaagaagaatgtccatgtctcctccggtaggaaaacggtcggcagcatggttacaggctcactcgctcttttctatcggcaagaaataggatttcttaagttcataacgaatacgctttgacagcgtgcaatgttagactagtaacccctccaggcccggggcgaccttaccgggcaggaattcgatgacctcgtagctggctgcgccggccttggcaaagggatctccggccaggatcgcctccaaggcttcccggctggccgcccgggccaggataaccccgcccgtgcgcggcagttgacggcctgaggccaaaaacacgccccgggcatagttttcatccagatagagcctgtgggcatcgagcagcccgtcaataacctcaaggggctggcaatagcgcagcagtacgacgaacatggcggcctccttttcctttggggacaaatcctataagaaattcgaggcctgtccggcaagggagacagaccagccaagccccaaggaggctccgccatggaagacagcgatatcgacgacatcgccgccctgctcgacggacttaaactcggcgctgccctgggctgggaagaagtgcgccggatcgccggctacatgcaggtcaagagcttcccggccggcacgacgatcattcaggaaggccgcaaggccacttctctggcgttcattgagaaaggcgtggtcaccatccaaaaggaagaggccgggggctgcgaacgccacatcattgacctgacccgcgacgccgtcatcggcgaaatcgcctttttcgacagcgaaccccgctcggccacggtggtggccaagaccgacgtgcgcctgctcatcctcacccgggagcgttttgacgaactggccgcaatcgaaccacagctggccatcaagacgcttttttacattggccgggtgttgagccgccggctgcgccaggtaacgggccgcttcgtgggcctgctggcctaagaccgaatcgctcacggccaaggccgacaagagcgcaaaaggcgtctgccccgaccggaagcagacgccttttgcgttcagagatggcggaggacagctgcctaggctggcagcgcggcctggccggtctcgaggcccgaaatgacggtctccagctcccgggcctggccggccagagcggtgacagcccgggccgaggcggccatggcgtcggatgtgccgtgggagatacggctgatttcctcggcggtctggcgcatctgctcggtggtggccgactgctcttcggcggcggctgccatggagcggatctggtccgaggtgcgcgagacgatgccgacgatctcttccagcatgacaccggaggcatgggccttgtccgtgccggcggcgatggccctggtggtctcgtcggtcttggcgctgttgcggcgcacgctttgctgcatggtggtaataaagccggccacatccttggtggcggtcatggttttttcggccagcttgcggacctcatcggccaccacggcaaagccgcggccggcgtcaccggcccgggccgcttcgatggcggcattgagcgccagcaagtttgtctggtcggcgatgtcggcaatgacgcccatgattttgccaatgccttcggcctggtcgccaaggtcattcatgtcgcggcgcagttcctcggccaactggttgacgttgccgataaccgtggccacgtcggaaaccatgccggcaccggcggtggcctttttccgggcgtcgtcggccagggcggcggcagcggcggcgttgcgggcaacttcaaggacggcggtgttcatggcgtccatggccagggcggtttcgccgatgcgctccttctgctccacagccccatgctccaccatgtcaacttgatgggccagggcctcggtttccccggccagggcgtcggcgatggccttggcttcccgggccgtggccagcatccggtcgctctgctcccgcatgagggcctcgctgcggcgcagatcagtataatcggaataaacgcaaagtgaccccatcatcttgccgttgatggcgttatacagcggcgtggcgtcgatgagcacattgcggacattgccctggcgcgaaaccagatcgacctccttgcggatgccgcgcttctcggccatgcacaggccgagtacggtcttgcgaccgggatcgccgtaaaaaaagccggccacgttctggccgtaataatcttcgggacggccggagtgctcgataaggcgcatgagatcgtcgttggtcagccgcaggttctcggcctcgtccaccaccacgaatggggtggccatgccggccacgatgccttgatagtagcccagggagttctccaaatggtggaccatctcgcgcagcgactggccgatagcttcaaactctttgggcagccccgtacgcaaactggagccgaaatggccctgggcgatggccccggcatagtcgacgagggcttttgcgccgctggtcacgcctcggataagcccggtgatgaggagtaaaagcaggaccaccgaaagcacggccatgccgaggaacatacgaaagaccgtggcctcgccttcctgaatggcgtcgaggttggctttgttggcctctcgctggatggcgacggcgtccaggatgatttttttcagcgcccgccactgcggcgtctcctcggtattgagcagttgcacggccttggccgggtcggtgggggctatgtccatgaggcgttttttcagttcatggctggtctcccaacgggggccgatctgacgcaagtcctcggcaatgcggccggtggccagggccgtcgccgaagcaagcgcctcgcgaaactgcttgtcggcattggcgtagttgtcccgggccgttttgtcgctgggattgagcaacacgtttctcgtggcctgctcggtctgcagcccctgagcgtaaacgtcctgaagatggtataaaagcggtccatcgacggtgctgacgtttttgaggtagccaagcatcctgtcttgctgcatatacagcagcataagggtcaaacttgccccgatgacgctggccacgccaagagtcaacagcaaggattttaggctcaagcgactcataatatcctcccgggagtcaggcgataacagacggcgcacacggctatgcgcaccctgggagcgccagccactgcgacgaaaaggtttcatcagtgtaccgctgcctataacctgacgacaccccttttgcaacaaaacgatgtcgggaaatttctcacaatatccacaaaacttctcaaatctaacactttgcgattgtgaatttgcgaacaaatagcaacagcaactctctactcgtctccacattcacaacaaaacgattcacagagagcaccaaccaccatcagtttaaagtcataatgacacagcatagcacgaggtagaatccgacagattatcaacattacctaaccaagccaaagtcaataattaaactttattatttaaaaaaaccacaaagcactatacatattcaactcgccaaccaccatcaatattttaatacttttgttaaattcattcgccttggttgtgactccagatcacaacattatatcttcaaaaaactaaaaaattttacccgtaacatagctttcgcaacaaacgcaattcataaattttccgtcaatctgatgtcttaattccacttacacctggtaaaaattggttttcaccgtggatttatagtctctatcgccaacgacaagattggctcagcgacaaaacaccttcgattttcctttttcaaccgcgaattctcggagagaccaatcgtcaggacggcctcggaacaagagacaagagttcgacgacccaaaaccggcaaatctcgccgatggcagtacgccagcgacgtgcacaatgaccctagggcccgacaccaaaaagccaggatgtttcagacgtattgcgggtctcaggtgaaccgaccaacagccaagcccgcagcatttcggaaatcagaccgacgaacccacgaaaagggcggtcgctcggtcggcaggcggcgccacgcaactgtcacggccttgaactggcttaaaaaaaagcttttcccgggcggccggccgggataaaagcaggtcaaggggttctggccagcctggacgccttgccaccatgccgcacatcagtcgccggggcttgcctgcggcggacttaaggagatttgcccatgcgccgtacactccccctgctgcttattgccctggccctggccgccggttgcacccgcccgccgtatgccaagccgggagccgagctgaccgccgtggaagacgattataccgactgctacagcaaggcttcgctggacgtgaacacgccgccgttcccggaccggccgctgacggtggtggaccaagacgccgacgcctgcatgaaggaacgcggctacgtttccaagatacggctcaactaacatggcattcccggtgacaggccgcgcccggagtctcggcgcgctgtccggctcgggttttgtcgaattcatccagaagctgttcgcggctcggggaagcgagacttctccccccttgcgctttggggaaaatgcgttatcttgaagtttcgacgggggcgccctggtttcgacggggatagtgaagccctggttgcaggtcgaggtgccgcgaggcctcgtaaaacacgcggcaactggttaactgccaacgattacgactacgctctggctgcttaatgacagccagcgttccatcagccgacgcctgatacgctgaaccgggacgccaaaccccatctggctggcgcaaaccttcgtccgttgaggtgagcgcgagaaccaaagacggactggccagaggcggcccggccggaaggcctgcccgaggcgagattgttttccggtctaagcctgtagacgcctggagtggagcattctcggacgggggttcgattccccccgcctccaccatccaccccctcgacaccgtccgttacggttcaaaaagtcagaaatttcagccaagaagccggtccgcaagggccggcttcctgcgttttggtcaatgccccaaccgccatggcctcagcggccgagcgcttgcgcaaaatacggagagcttcgttgtgcgttgttcaacgaaagcgcgcagcaagttttggcagttcccgaggcgtgtgcgttgacaccccccgcaggcttggatagccctcccgaaaccccgcgattccatgctgggcacaacaccaccgcaacaagccaacaacacccatgatcgtcacccgcttcgcgccaagccccactgggctgctccacctgggccacgcttattcggccctggccgcccatgaagcggcccggaaggccggagggcggttcttgctgcgcatcgaggacatcgatcccggccgctgcaagccggaattctccttggccctgatggaagacctccgctggctggggctaacctgggaggaaccggtgcgcttccagtcccaacacatggaggactacacggcggccctgggccggttacaggccatgggcctcgtctatccctgcttttgcacccgcagcgaaatccaggccctggccgcgccccaggaaaacgacgtggaagggccggtctatcctggcacatgccgcgatctcgccgcgaccgcgcgcgcggccctggcggcagaccgtccctgcgtctggcggctcgacatggcccgagcctgtgtcctggccggcgacctcgtctggcacgacgacggacggggtgaagtccgggccgatccggcccgctttggcgacgtagtcctggcccgcaaggacgtgctcacgagctaccacttgagcgtcgtcgtggacgacgctctgcaaggcgtcagtctggtcacgcgcggcgaggatctgttcgcggctaccgacgtccaccgtctgctccaggcactgctcggcctacccaccccccgctatcgccaccacacgcttatgcgcgacgcctccggtcggcgttacgccaagcgcgacaaggccctcaccctgcgcgccctgcgccaatccggcaaaacgccccaggacgtgcgggacattgtcggcttcggccagctccctggttgatccggcaacccgccaacacgccggcctcagctctcccttgcattgttcttgccgggcacgcccgggggcaactgtttatccggcctcgcccttactgctgacgatgccaaagatgcagcgcggtccggcaacaaagccctctcatccaagagcgtcctgcccaggcggtttcgcgacaagctcagcaatgcgaaataacttcgccaagccgttgaagacgttgccacatattgacaacattgtgcacggcaagcatacccttagggctacgcgaaacataggcactcatcttccatgccgctcggaccgacgccatcctggctggtggtctcggcctgccctgcgagaatttgcatgcgacaccttgcccttgtcctggtcctcgtcttgatgccactacccggtctggccctggcggccaatgaacttggctatgccgtgcgcaccggcgactacagggccgaaaccaacagcctaaacggctggacctacaccacgaccttcggcacggcctatacccgcgtcagcgaccccacgttccaggccttgtcctatgattccagcggacgggtggcctcctatgtcattgccggggaaacccgctacgtctattacggcgacgacaccgcgagccagatccgggacaaggccgcttccgtggcgttgcagcaagccggcaacggcttcaatctgctggccagccagcgagccatcgaccgcactatcttcgaccggcttttcgccacgctcatcgccacccgcctgggagccaaaggacttgccgccggcgacgacacgcccgcttccatggcggtctgggccgacggctcctacaccatgcagggcagcagccagaccggttcccaacatgcctccaaccagtacatcgccctggccggcctggactacaccgtgtccgaccgactgaccctgggctttggcgcgggatttaaccagaactttaccgactaccacgccggtaaagcctccagccagcgcgacgactatttcatcttcaatccctatgccgggttcaccctctgggacaggctgtgtctgggtttgcaggccggtctcaagtacggccgcaccacgctttcgggcagccagtccggcgactaccagtccctgaccacctcggccggcggctttctgacctatgccttcatccgcgaccggctgatgttcaccccggtggtcggctacagctattcgtatcgcaatccttacgccgacggcgtggaggccacggccgtgggcatggccaaggccggcggccggctcacctaccagttcgagaaggtgcttccctacattgatctggcctacaactacgacaccgtgggccagatcggcggccaacgcagcgacatgctggccaccgtcggtctggatttcatgccgaccaacaccttcagcatcggtctgttcgcctccaacacctttttccggggcaaggaatactgcaccaccttcgacctgaacctgcggtatacgttctgacggcgcgacggccgcgacaacacgccggccaaggagattccatgtcccggtttgcttgccatggcatcgatttgcttgccacgatctgtcttaccctgctcctggccttatgtctggccgacacggcccaggcggccaaggaggccgagccggccggcgtcgtctcggccattgaggatgcggtccaggccatcgccgccgacggcacgagccgcgagctggccctggaatccccggtctttgtcggcgacgccatcgtcaccagccctaccggcgcggcccgcatcagcctgcaagatggcacgatcctgaccttgcaggcggagtcccgtctggaaatcaaggatttcgcctacaaaggccagtccaatgacgccatgcgcctggctgtctccttcgtatccggcatatgccggctcctcagcggccagatcgtcaagaaaaaccctgatcggtacgtggttgattccccctacgccaccatcggcatacgcggcaccgagatcggcacgcgcatccggggcaatgcccagctcgtggccctgctctccggcacgcccattagcgtcacggccacggacggccagtcccagaccatcccccagccggactacggcgtggacctgggccccgggaaggcgccttcggctccgcgcccgctgaccgaagaggaaaaaatgctcttcacccgcctcgttttccgccgccagatggacagcatgcggctgcaaatgctgttgcaatccagccggccggtcatgcggccggggcggttctaattctagcggcaaggccgctgtcgttcctgtcctgctccaagacgcacgagcaaggggccggcctcaaggaggtcggccccttgctcgtgaagacgattggacaggcgcaaccttctggctgtcgccaaccagcgtctcttgcggaatccccgtctctctcggcaatcacggtgacgaccggtcgcgacgactgctcgccgaagcgacgtttcgacgcctgacggccaagccggaagatcgttcagggaaaaggttgcccgaaccggtccgccgcaacgctgggccaggcctcgaccagtccgtgatgatggtccgcgccgtccagcaccagacaacgcgcctgggaggcgtcgcccagcctggcaagaaaccgccggcacagccagggcggcgtgttggcgtcgcccgaaccggcgatgtgcgtttgcgggatgtgggccacgaccggggcgacgtcggccggattaggccagtccggcggcagggtcaggccatgcagctcggcccaggccgcgaaatcaagattggcggccacggtgaacagggcgaccacgtccgtgcgcccggcggccagcagcacggccagggcgccgccgccggaatagccgaccagccccaggcggtcggctccgtaaacggccttggcggcgtccagggcggcgctgaggcaggccacggttcggggcgcgtagcgctgcgtggtccacagcgtcggatcgaggtcggccaggacttccagggaaaggtattgccctggccgggccagatagagcgccttgccgccgggaacccgggccgccagacgcaggcccaccggatcggtcggggtcggatcgtccgagggccttcgccggtcgcggtaggcctggccgtcgccctcgatatacacggtaagcgtcctgcccggtccgtttcggccataggcgacaaggggcacgggacaggccgggccggtctccaaggcgatcggcgtcaatccgcccgaggcggcaatggcggtcgcctgatcgcggcgcgcggcgctgcccggcgtgcctgcgcagccgctggacagcccagccaacagcagacacacggcgaccagaaggaccgaccctgagcggcccggacgcgctatggcggagacattgacggcggtcatgaggcttctcccgggaggtggcgcgaacctgcgccagcctccgggcatgatggcccgaaacgctccttggggcaatacgaccggccgaccgtcaggtggcgcgataggcggccaggcgagcggcgtccggcggttttcggccgtcgaagtgccggcaagccgcgaagtagcgcagatcggcggcccagactcccaggtcgcgcaggccaagccccagcagattgcgccagccaggcaggccggcggccagatccccaagcggccccagcagttcggtggggtcgcgaaagcactcccagtcgcaggcccggcaaaaggcttgcccgtccaaccgctcccggccaagcttccagaacggtcccaggttctcgcgtccccggtagccgcaggggaagcagtcgccctggcggtccacgtaaaaaaagctcactccgccaaggcagggccggtcagccctggccgcgcccgcgtagcgccggaccagggcggccacggccgaacggggggtgaaaatacgcaaatctccacgatgacgcaccacggcggcgtcgagagcggcaaaaagcgcccgcttttcccattcggcaaagctgacccgcctgtctgccgccgtagccgcataggcagccgaagcccccttggccgcatcgtcgtcgctcatggggtagcaacaattggccatggtaaatcccaagccggcggcggtggtgaaaaagcgcgacagaccctggccggccagcttttgaaagctgaccgcgtcgtccgcctcaaggggcgtttcgccggtcatgaggcgggtcagggccagattggccgtgggatacaggccatgggcgtgaaaaacgggcaaagcccgggcaatcccctccatcagcccgggaaagccccgattggcttcgtggacgccggcatgggcggaatccaggctgatccagaaattgcgtaccggcgtggcggcaagcatcgcggccaaccgggtcacgcggtccatgaaatccggggcgtcgggccgggcgaaccggtagccattggtgccggtgcgcagatactcgataccggcccggccggcgtaatcaagcagttcgcagagcaggtcgccggccaggagcggttcgccgccggtaaaggacagggctgaaacacctaggacggcgcagtggtcgatgatgcgcttggcggtctcgcggtccaggtcgccgcgcgggccgccgttgccgacgttcatgccgcactggaagcaccgggcgttgcaccggtcggtgagctgtaccaccacctggcgcggacggccccgacggcgcagtattttgagaatcggcatggtgacgggctactcccggccgggcgcggagccatgaccagcaagtgacaatagcgcgtcggaccaagcccggccggcccctgacgccaaatcgtaacggccctggggcatgaagcggccatggacgtttccgccgcgccagggccgcgcatcatcgcctgctgcaaccacaagggcggcgtgggcaaaaccacctgcacggtcaatctggccgccggactgtcccggtccggctggcgtgttctggccgtggacgccgatccccaggcccatctgactgcctccctggggctggccgccggcccggacggcgggttggccggtctgctggacggccggcttggactggacgccgccctgatccgcgacggcgacctggacgtgctgcccgcctcggccgccctggccgggacggaaacgcggctggccgcgtccgccgcgccgaccgatcttctggccagctacttggctgcggcgaccgaccacgacgtggtcctcatcgactgcccgccccatctcggccagttggccaagcaagcgctttatgccgcaaccgacatcctcattcccatgacgccggatttcctggccatgcaaagcttggcctggctcatggacaccttggccgagttggccacgtcgggcgacaccccggctgtggccggggtcgtgctcaatcgttttgccgcccagaaacgcctgcatcgggaagtaaaaaccctggtggaaggccatttccccggcatggccctgactaccgtcatccgtgaaaacgtcgccctggccgaggcgccgagctttggccaggacatcttccgctacgccccccgcagcgccggcgcggccgatttcgccgctctggccgtcgagacggccgtccggctgcgcctgccgcccccggcctctgccggcggcaacccataaggaaccgaccatggccaaccgctcccgcctggggcgcgatcccttgcaggccgcgcccaaacctcccgcctccaagcctgccaccccccgccgtaaaccggctgccgccaagggcaaggtttcggccaatacggccacgaaagagccggcagccgccccgaacgacggcagcccattgccggttgctgtaaccgcggccagccccgaaggtactccggccttcgacgcccccaagatggcccagccgttggcggacgccgacagccaaaccccgtcctcggcccaggttgcgcaagacgccgccctggccgaggccgccatccccgcccagcctgacgctgtcgccacggacagctcgcccgagtccgctcctggcgtggcggctggccctgctcctgaagcagaccagccctccgtgccgtccagcgcgcaaggcccggaccagccgccagcggtggccaacaggccaacggctgcgccggcccaggctcaagaagccgccgccggagcccaggccgaggccgtgcctgcggcaagcgcggccgcccctggcaataagtgcccggccgccggcccggccctctgtccgggcacggcaagtccgcccccttgtccgagcatagccagtccggccgcttgctcggactcggccagcccggccctgtccaccgacgcccatcccgtggccgtgtttctgcgcggcgtgctcgaaggcttgctccccgaaggcgaagccgccctgtgtgtggacgtcgacgagtcgacaagcaccctgccggtggaaaaactcttttttttcagccacgccctgcaacgcatcgccatgcccctggaaaacgccgcctcggccggctggcggccgggcacggccaccggaccgctgccggtgctcaccgcgcgcttacagcccattggccggggccgccacagcctgacgctgttcgataacggttgttttttcaaaaaccgcctgccaggcctgagcctgggcatggaagccctgacgcccctgaccgcctttgtcgccaaacgccagggttcggtcatcctggcccagggacgcgtgaccgcttttgaaatcatcggctgacgccgccaacaaggagtctcacatggaaaaggacaagagccggatcaaggtggaaggggtgatgcagatcaccgaagtcatcgccaacctggaaaaactcgcagccgacatgaaagccggcctggtcaccctggccgccggcgatgagtcgctgacgctgcggccttcggtactggtcaacgtggacatgaaggcgtcgcaaaaaaaagacaaggaaaaattcgccctagagatttcctggaaaaagcacaaggaaatggacggattcgcgggagaataaacggcataggcctccggctatcgggagaagggcaccacggccaccctcccgtttagccggagacctatgcccgtccaataccccccgtacagccagagcagttatgggctcttatcattacggaggctccacagcccaaacaactcgtatagcctcccttaatagaaacggttttttcagaaaaactcatgatattagtatattgcctacgaaatacctatgcgctcttcgtgggcacgacactaagagatgatagcgtgtggattgatgccgaattcgctctgcagcttttgctttgcccgttcttcgttcttgtaatacacatcttgatcaagcatagactgatggccacaaccgtggtctatataatccgaaatatcgcagtgacatgccgcatacccgaaccgatgcacatcatgaaaccataaagcaccggtatctacaccataccctccgcaagaagcaatgcagccgaaaggagggacagaaccaagcggacttgtaaccgatcgaaccaaccgcatattaatcagacacgaccattcgtttatgcgacatggaggaagcggccaaggatttgatctgtatgcttcgcagaaattcgctaaatgaaagggcgtgcaattcttaaacttttcaaaatcatgcttttcatacaaatcgaataactcctgataagtcggcctataggaaagatatttttcgcctgagcacttcttcgcatgatacgcaggacaccccgcacacgcgccaacatttcctgcaccaatatgctctttgcacttgtccaaataaagcccgactatatcttgcttatgatacgtatcattatgacatatataaagataatccttatcagtcctctcccaggcatattgatatcgcacagacagcctggcgtcttcttcaattatcgaatcaacatccatcaaacgaatccagtaaaaatttttcggaacataaaatatcaatcttgatttcagcttgttcttaataaattcaaatccgttcaactgccttggcgtatttgcattttccgctatgaggtatattttatctatatacttatgactgtgcttgagcagcgacaaaatagacaatgtcgtctggaaaggcttgcctaaagcattcactgccacgtcaacaactttcaaagacatatcgactccacaacaataaacaaagaacccagtataaaacatcaaaaactgcttgtcataaccaaggccttgttccgctgccctcagccctgctcctcgaaaaaccggatggcgtttcgcagttctccgaaacggtagatgttgtagtgggcctccaccccgtccatagtctgctggccctggcctgtagcgaaaaagactgtacgaaggccggcctggcgcgcgccgtaaatatcgcggtacatgtcgttgccgacaaagaccacgtcttccggcggcaggtgcagacgccgcagcgccagggcgaagatgcgcgggtcaggcttgcgatagccgagatcgcccgagacaacgatgggatagaaatattgctcgatgccgaccatgcgcatttcgggcacggcccagaccgactgggcatcggacaagacagctagccggtagcacggccgcagttcgtcgagcacctcgcgcacgtcaggataaagctccaggcgattgagcgaaatgccccggtacagctcagccagaaaatgcggcaactgggccagcttggccttgggcaggctcacgcccgagcgctccagccgcgtttgcagaaattcccgccacaccgccacggcgtcgaattccggaaacgcttccccgccggcccgacgctgggcctttaaaatctggtagtagccgtcgcgcacgtcgccccggctggtgcggatgccgtaatacttgagcaggtggctgatggagcggtagatctgctcgttgccctcatcggtgttgatgtcgatgagcgtgccgttgatgtcgaagatgatggccttgacgatcatgccagtcctccgctcaggatcacccgcgcctcatggacgaggcgcttgcggtagttcgcgtccagccagccgttgcgggcgatgcgcaacagcgtcagccccagatgaaacggcagccggccggacagggaggcaaaggtgcgctcccgatccggaaaatggccggcgtattcccagaggaaatggccgatgaaaggctcggcccggtcgatatcgccggtcatttgcaggaaacagtgcttgagttcaccgcacagccgccccacgtcatagacccggtcgtcgcggtgcatgcgctccagatcgatggcgtagaccgcctggccccggccgaacaggaaattggacggcgtggcgtcgccgtgcaccgccacctggacgtcctgccagtgttggggccggacggcgtaggcatggccgagttcgtagagccgcgcggcccggcgctcggaaaggccgccatgggcggcgagatagcccaccacccggtcaaagtagccctgggtgcggttaaaatccacccgttcgggaccggcggcggcgttatgcagccgggcgaaaaagcgggccagaccggaaagcttgcgaaaaagccggtcacccctcccggccgtggcggcggcggcgacaatggcgtcgagctgttcgccggccaggtgttcgaccaccagcaggtcgcccaggtcctcacgcacgcccaggggccgggcgacgtagtccggcggcgcatccaggcccagattgcgggcgtattccaggctgcgacgttcgttttcggcggattggggcgcgttgctgccgttcaggccccgggcgcggccgtaaaacttgcccacgacccggacttcggtccatttgtcctcatagaggtagacggcgctttcggccgagacgcggtagacccggaaacggggttcctgcccggcctggacaagttgcggcaaaatggcgtcgcgcaagtagccatgaagcggatcggtggtggcgaggtgtccgagatactcacgcatgggcgacaactttgcaggcttatgctacatttttgtggttctgtatcatattgacgcaggcaccagcgtgtataaccatggttaacctatgccaacacttgccgcttgcaaataccccgccgcgttatttcctcgcgctccggcgaatccggcctactttcgtgaattgccaaacaatcccggacctcaacagacacctggggaagacaggcggtcggaaccgacaacgggggaccacggttcgcgcctggtctgcgccgcctgccggctcatgattacggccccttcctggcgcgtagccgtggccggctcccaccgccatgtttttgccaatcccctgggtcatgtctttgagatcggttgttttgccgctgccccaggttgcgccgccgtgggatcaccgacgtccgacttctcctggtttcccgggacgctctggcaagtcgccgtctgcgtcgcctgcggcctgcatctgggctggcgctatgtccaaaccgacggaggcacgtttttcgggctgattctcgaccgcctgcaccagacgccggaaaacttggcctgaatcctgcataataaattccaacggagcacggcttgccaggcaggcaggacaccctatttaaacttgactttttcggtaggaaaatgttgtctcccaaccctgcaacgcggacggatgtcaagttcccgccgcccggagggatcgatatgaaccacctgacccttatccccacaaccccgcccatcagcctcacctgggctgatgacgcggacgacaaggacaccgtcgtgaaatccgttttcgacaacccgattttggccggcgccgaccgcatggtctgcgcccactgcggcgaggatgtcacccgaggcagcctgcgcatcgccgtcaatggttcccatcgccatctcatgcccacagcccacggcatcgatcaggagatgggctgtttttccctggctcctggctgcatgaccgccggtcatttcgccatggatttcggcctgggtgaggacggcttctggcagatggccctttgcgcctcgtgcggcaaccatctgggctggcatcatgaaaaggccgacggcatgggcttctacggcctgatcctcgaccatctggccccggccgccgatgtcgacaaggacgccgcctaacgggaggtccttgccggcaagaacaaccgcatcgcgttatcccggagtaccccgctcggctcccttgaggcggttaccccagaacgtctcgcccccgcagctccttcgctccagacgccgctgcatcacaaggctcgttatgcccttcgccgcgaaagcctcccagccggaggctttccgccccggaggtcatgctcctcaatccacgattgtgcgactgccagacaacgtcatgcctccgccgcattccagtcggaccgcagacgcgaagccgcgacacacgccttgcgaccgcaaaccccaaaccgtcggtggctttcggccaaacccagggcacaaaaaaagccgggagctcgaaagcccccggccggaatggtcttcttcgtcgtcgcctgccttaggcgacgctcaccgtgatcacgtcctcgaactcggccgtcaccttgaagctcttgccgccggcttcgacgaaatagtcgttgcccggaaagagttggacattggcgcaaaaagcgtcgcccacatagatgtccttggcttcaccgttggtctcgaagcggatggtggtgccgtcgcttaaggtcaccatctcttcatgattgatgctcttgggaaggtcggcttcggtgtagttgctcataacgctctccaggtttggcgattataaggcctgcccgctcgcgacgggccgataaccgggatatttgttttgaacctacgcccgtttgcgccgaaagcaaagtcgtttcgacatttaccagcctaaaacatacgcaaaaatgagcggcgcgacgatggaggcgtcggagttgatcatgaaccggggggtgtcgatgtcgagcttgccccaggtgatcttctcgttgggcacagcacccgagtaggagccgtaggaggtggtggagtcgccgatctgggcgaagtaggcccagaaaggcgtgtcttccagctccaggtcctggatcagcatgggcacgacgcaaatggggaagtcggccgcgatgccgccgccgatctggaaaaagccgatgggcgtgccggccttgccctgctcggtgtaccacttggccagcacttccatctgttcggtgccggtgcggatggcgttgtggcttttcacgtggccctgcatgacctcggcgcaaaagatgttgcccagggtgctgtcttcaaagcccggggagtagatggtcaggcccttttccttggcagccaacacccaggaatgttcctcggggatctggaagaactgggcgatgtcgggctgatccagcagcgcgtacatgtattcgtaggggaacttgggttcgccggcttcggccgcggcagcccacagcttggagatgcggcgctggacctggcgcaggacgccttccggaatgcaggtatcggtgacgcggttgaacccctggtcgtacagcgccttttccgcctcgggcgacaggtcgcggtactcgggcaccatcttgtattcgttgtggttgaagaggttgaacaggtcctcttcaaggttggcggcggtgcagctgatggcgtggaccttgtcctggcggatcatctcggccagggaaatgcccagttcgcaggtgctcatggcgccggccatggtgagaaacatcttgccgccgcgccccagcagatcgttccaggccttggcggcgtccagggtctcgcgggcgttgaagtggcggaaattggtttccatgaaacgggatatggaagacattgcggctccttgggttattcctgggcggaagcgacgctcccgcgtccttcctgctccgttgcggcgtccggggaagggggcaaaaagccctcgaaaacaatgttgtccccatggcgcaaggcttcgaccatatcctctctcgcgcgcaccgtccagagcagaaccggcagcccgagccgccgaaaaagggccggcatcaaacgcggcagcccccaccagccgtaagccagacagtgcggcagggccacggcggcatgaagcaggttggcatagacaaaacgcttgacgcgtcccatgtccgtggccttgtcgaaatcgcaagagatcaggcaacgcgggagatcaggacgcagggcggccatgcgggccagggaaaagggatcgaacgaagcggccaggacatggccggcgtaaccgtccagcataccggccacggccggttccagccgccccggtcggctgtcgcctttaagctccacataaagcggcacgcggccggcgcaacgggtgagcagttcgcgcaacagtggcggacgctcgtccgtgcccgcaaggcgcagctcccggaggtcgggggtccgcaaatcctcgatccggccagcgcggccggtcagccgcgtcaggtctgcgtcgtgaaagaccaccacctcgccgtcggccagcaggcgcacgtcgcactcgatgccgtaaccggcggttatggcggcgtcaaaggcggccagggagttctccggcccggtgtccggtccgtggagtccccgatgggcaaagggaacggccttgacccaatcgatgcagaggcgcgaaagaatcggcaattcgccgtcccggccgacccggctacaactggagcagcccagcaagggcggcctcgatgcccggctggtcgatgccgcaaagggcgcgcagggccttttgggagccatgctccacaaagccgtcgggcaggcccaggcgcttgatcgtgaggtcggccagcgccccggcgtcggacatggcctcgaccacggccgagccaaagcccccttccagcacgttttcctccaccgtcagccagcgtttgtgggtcttggccagctccagcagttgggccaggggcaggggcttgatgaagcgggcgttaaaaaccgcaacctgcctgcctgtgcgggcggccaaagcgtcggcggcggccacggccggcatgacccggctgccgatggcgacgacaaggccgtcgcagccctcgcgcacaagtttcccctggccgatgggcaggggctcggccttgtccggcacgggcaggcccacgccggccccgcgcggatagcggatggcggtcgcgccgggatgagccagggccgtggccagcatggccggcagttcggcctcgttgcccggggccatgcagacgagatttggtatgtggcgcagataggaaatgtcgaaagccccgtggtgggtggccccgtcctcgccgacgagacccgcccggtcgaggcagaagaccacggggaggtcctggaggcagacgtcatggacaatctggtcgtaggaacgctgcaggaaggtggaatagatggcgaccaccggccgaaatccggccatggccaggccagcggcgaaggtgacggcgtgttgttcgcagatgccgacgtcgacgaactggtcgggcagctcggtggcgaactgcgacacccccgtgccttcgggcatggcggcggtgatggccatgacgcgcttgtcggccttggcggcggcaagtagcgcttcgccaaagacctgggtgtagctcggcgggcagaccccggccttttccaccagcccggtctcgggctcgaagcagcccacgccgtgaaaataggtgggattggactcagccggctcgtagccccgccctttcttggtcagcacgtggaccagcaccgggccttcgatgtccttgacttccttgaagacctcgatgagccgctcggtgttgtgcccgtcgatggggccaaggtagttgaagcggaaggcttcaaacaacatgccgggcgtgaaaaagcttttaaacgactcctcgccgcgccggacatagcccatgaggtcgccgccgtaaggcagcgaaccgatccaactttccatgtcctttttgaggcgtttgacccagcgctggttgagcttgcggctcagaaacagcgaaagcgcgccgacgtttttggagatggacatctcgttgtcgttaagtacgacaatgagccgcccgccccagccgccggcctggttgaggccttcgtaggccagcccggcggtcatggagccgtcgccgataatggcgatgacgtcgtggtcctcgcccttgcggtcccgggccatggccaggcccagggccgcggaaatggacgtactcgagtggccgacgccgaaatggtcaaaggggctttcggccggacgcggaaagccgctgacgccgcccatggtgcgcagggtatggaactcttcctggcggccggtgaggatcttgtaggcataggcctgatgccccacgtcccagacgagcttgtcgtgcccgggatcgaaggcggcaaggagcgccagcgtcaactccacgacgcccagcgacggggccagatgaccgccgttcatggacaccgtgccgatgatgacctgccggatttcctcggccagcacggtgcgttcctcggcggaaagccccgccacgtcgtggggatgcttgatgcgggtcaggatgcgcagggccgcgtcgctcattgccgtcatgtggtcgtatccttgtggttcgcgccggaaagccgatcggcgcgccctggggtctcgttatcaaggcgcgggcaggcgcccgggctaccatttgtcgcgatgcacgcggtcggcccgataacgatccaccggggccggggtctcggccggatggccgatgacaagcagggccatggccgtcactgtatcgggcagggacaacagcttgccaaaggcctctacccgctcgggcagcggataaatgccggtccagaccgcgcccaggcccagggcgtgggaggccagcagcatgttctcggcacaggccgaacagtcctgcacccaatagccgccgcacttgtccagggaaatgtcgccagcaaccaagatggagaccggagcgttcttggcataggcggcgtaggggttgatgccgccgattttttccaacacggccttgtcgcggatgaccacgaactgccagggctgctcgttacaggccgaaggggcctgcatgccgcagcgaagaatggtctccactgccgcgtcgtccaccgggtcaggtttgaaggcccggacactgcgccgggtcttgatggcagccaggcaatccatgccgccccctcccggcccgccctgggccatggcccggccaggcaaaaacaccgtcggaatcaggccggccagaaggccaagtaccgtccgcctcgccacccctatcttgtcgcgcgacatgtggtgttccccttccccgatctgcaaaaccgggagctattgcacccggaccacgatatagcgggccaggtcccgtaaaaactcagccgcttcaccggcatagggctcaatggcggcaatggcggcggccacgcgttcctcggccagccgccggctttcgtcaaggccgatcatggaaggataggtgtttttgccctgctcccggtcgctacccacgggtttgcccagggtcgcggcgtcgccgatctcatcaaggatgtcgtcaacgatctggaaggccgcgcccacggcctcgccgtattcccgggcccgggccacgccctcctcgcccgcgccggccaatatcgcgccgcacacgcaggaagcggtcaaaagcgcgccggttttcagggcctgcatccgggccagctcggccagggtcacgccttcccgggcggtgtagtccatatcgaggacctggccgcccaccatgccggccgccccagccgccttggccgcctcggccagggccggcaacaccagctcggccgctactcccggccagacccggcccatgcagccgaaggcttcggtcaaaagcgcgtccccggccaggatggccccggcctcgccaaaaactttgtggttggacggccgaccccggcgcaggtcgtcgtcgtccatggccggcaggtcgtcatggatgagcgaataggtgtggatgatctcgaagccggcggcaaagggcatgaccctggcccgatcggcgtcaaaaagctcggcgaaaacgagacacaggaccgggcgcagccgcttgccgccggccaacaacgaatattccatggcggccagcagattctccggcacgccgcgctcgcgcatccgcgcgccgaagcgctcgcggagatacacttccacctcgccggccatcacggccaaccgttccttcaccgtcacgactcctccccggccggcccgccgtcgcgagcggcctcgtcatcggcaacgtcaaacgggaccacagcgccgtcctcgccggccagactgatttccagccgggccgcctccaggcgcttgcggcacgaggccacaagtcccatgccctctttatacagcgccacgcccttttccaggggcacgtccccggcttccagggcgacggctatgcgctccaggcgcgccagcgccttttcaaagctttcttccttcacgctcacggctgttctccgtcgtcgggtccgtcctgggacaccacggcccggacgcggccttcatacaccatgacgtcgagcttgtcgccgggccgcacgtcgccctcccggcgcaggaacttgccggtgcgaaggacagtggtcaagctgtagccccgggccaggggcgcggccgggtccaggccggccagccgcatggcggccacgtcgagccggccttgacggtcggcgagataaagccgcatgccagccgtgatccgctccttgcgtcgggtcaaggcgtcgtctcgggcgtccaggctttgacggtcaaagcgccgggccagacgcgcttccaggttgtcgagccgccgcgacaggccgtccagccgggcggcggccgcccggagcagacgcttttcgccgacgacaaaagcatcttccaggcgcgcaagccgccgggccggggagagccaggaaagtccccgggccagggcagcaagctcacgttcccgcaaggaaacaaggctcccgatctggcggcgaagcgacatctcggcgtcgtccaggcgctgggccagcatcccgcgctcgggccacaacagctgggcggcatgggagggcgtggccgcgcgcacgtcggccaccatgtcggcgatggtcacgtccacctcatggccgacgccgacgagcaccggcaatggcgcagcataaatcgccttggccacctcttcggtattaaaggcccacaaatcctccagcgatccgccgccgcgaatgagcaccaacacctcggcccagtcgtcggccacggctcgcagcatggcccgcacgatgccggccggggcggcctcgccctggaccagggtcggatagacacgcacttgcgcgccgtgcccgcgctcccggccaatgcggatgaaatcgcgcacggccgcgcctgtcggggcggtcaccaccgccactcgcgtcggatggggcggcaagggccgctttctggccgcgtcgaaatagcccttggcggccagacgtttcttgagctcctcgaactccagccacagccggccggccccgacttcctgcaccacctcggccacgagttggtaggttccgcgcggcggatagaccgtcaaacgccctgcgaccatgacctccatgccgtcggccaaaagcccggccaaaggtctttccagcacctcgccggtcagcggatcgtaacgctcgccgccaggcgtcacgcgcccggcctgcgcccccttgaaccagaccacgccaagagacgcctcggcgtcgcgcaaggaaaaatagacatgccccgagccaggacgcgacaggttgaccacctggccgcgcacccagacgaaaggaaattcggattcgaccacggacttcagcgcccgggtcagctccgccacttcaaacacatggggcatggttgtcgtcacttcgtgaagactgggggagggaacccctttttggaaaaaaggggttccctcccccagacccccaccctccccaaaaacttttaatgggtaaataggccgtgcatcgacagcgttgtctcaatccgcttgctcggcagatatccgtaatagccggtcaagctgcgataaagctgtcttgtcgctcaggctccaagcattcggccccgcttaggggccgagggccggttggggtcgggattttggccgggaataacggcgttcccgcgccgagattcccggccaaaatcccgaccccatcttcgcgcggcagcgccacccgcgcaacccagccgccgccgtccgcctgcccatgcgcctgacaaccctatcgcaggggtccggggggatcatccccccggcggggtctggggcaacgccccagtcttcgccttcgcgtccctcttcccccttctctctactctctcgacgcccctactccagcccccagccttcacgcacgccggcgcgccaggcagcaaacgcttcgaaaaagccttccaggggcagttcgcccttctcgccggtgcggcggtccttggtctcgacgatgccccgggccagtcccttgccgccgagcgtcagctggatggggtgtcccatgaggtcggcatccttgaacttgacgcccgggcgttcgtcgcggtcgtcgaggagcgtctcgatgccggcggcggtcagggcggcgtagatttcgtcggccttggcgcaggcggtttcgtccttggggctcaaattgatgagcgcggcttcgaagggggcgatggtaggcgggaagacgatgccgccgtcgtcgtggttctgttcgatggccgaggccacgatgcgcgacacgccgatgccgtagcaacccatgatcatgaactgttccttgccggcttcgtccaggaaggtggcgttcagggccttggagtatttcaggcccagcttgaagacgtggccgacctcaatgcccttggtgaaatcgagcagcgcgccgcacttggggcagggatcgcccggggcgacctcgcgcaggtcggtgtaggaaacgacgttggcgtcgcggccgagatccacgtggagcaggtgggcgtcggcggcgttggctccgaccacccagtcgtttgccagggccaactcccggtcggcgtagacgggcagggacaggccgacggggccggcaaagcccacgggcgcgccggtggcggccgtgacttcctcgggggtggccaggcggaggtcttccttggcgtccaggaggtttttgaatttcacttcgttgagttcgcggtcgccgcgcaccagcgcggccacggtcttgccgtcggccacgtagagcagcgtcttgatgacggaagcgaccgggaccttcaggaaggcggccaattcctcgaccgtgtgctggcccggagtggcgatcttctcggcggcggggcaaggggcgaggtcgccggccggcggacaaatggcttcggccttttcgacgttggccccgtagtcgcaggccgggcaggccacgatggtgtcctcgccggtgtcggccaggaccatgaattcatgggagaacgagccgccaatagccccggagtcggcggccacggcccggaacttgaggcccagacgcttgaagatgcgggcgtaggcttcgtacatgccccagtagctggcgtcggccccggagtcgtccttgtcgaaggagtaggcgtccttcatgacgaactcacggccgcgcatgaggccgaagcgggggcggatctcgtcgcggaacttggtctgtatctggtaaagattgaccggcagctggcggtaggagcggatctcatggcgcacgaggtcggtgacgacttcctcgtgggtgggtcccaggcacgattcccggtcgtggcggtcaacgaagcgcagcagttcccggccgtagaagtcccagcggccggactccttccagagatcggccggctgcacggcgggcatgaggatttccagcgccccggcccggtccatttcctcgcgcacgatcttggcgacgttgttgagcgccttaagccccaggggaagataggtgtagatgccggccgtgagtttgcggatcatgccggcgcgcagcagcagcttgtggctgatgacctcggcctcggccggggtttctttcaacgtgggggcgtagtagcggctcagtcgcatggggattcctttttttcggtaatgaagcgttccagttcgtccatgaaggcgggaataagcttgtccgcgccgcgcaccttgccgaggatctcgcccttgcggaagatgatgccgcagtcgcgcccgccggcgatgccgatgtcagcctcgcgggcctcgcccgggccgttgaccacgcagcccatgacggcgacggtgaatatttcgggcacgccgcgcaagcgctcctccacggcctcggccaggccgaccaggtcgatctcggtgcgcccgcaagtcgggcaggagatgatttccgggccgcgcgcgcgcagttccagggagcgcaggatttcgtaggccacgccgatttccgtcaccgggtcgccggtcagcgacacgcgcagggtgtcgccgatgccttcggccagaagcacgcccaggcccacggcggacttgaccgccccgcgcatgggggttccggcctcggtgacgccgatgtgcagcggataatcgaccttggcggcgagcaggcggtaggcggcgatggtgcgcaacaccgaggaggacttgagcgacaccttgatgtcgtgaaaatcccgggcttcgagcagggcgatgtgctccagggcgctttccaccatggcctgggcggtcgggccgccgtatttcttgagcagatgcttggccacggagccggagttgacgccgatgcggatgggcgcgccgtgggccttggccgcggccaccaccgtatccacggcggcctcggagccgatgttgccgggattgatgcgaagcgcgtccaccccggcttccagggcggccacggccaggcggtggtcgaaatggatgtcggccacaagcgggacgttggtggcggcgcggatggcggcaagggcctgggcggcggcctcgtcgaggacggccaggcgcacgatctcacagccggcctcggtcaaggcctggatttgggccagggtggcgtccacgtcccgggtgtcggtgttggtcatgctctggacgcgcacgggattgtcaccgccaacgccgaccgcgccgatgcgcacggttcgggtccggcgacgcggcgaaagaggcagggtttcttgcatggggagtttgggttaagagttgatccgggtttggcgggacatgtcgccccggcagccgcatgagtcaaggagcttaccagacatgaacgccgcagccgccatccggcaactgctggccgacgcctccctgggcgttttggccaccgccggccccgcagggccgctgacctcgcttatggcctttgccgtcgaaagcccgtcgagcttggtcatggccactttgcccgacacacgcaagtggcgcaatatgcttgcggaccccaggatttcgctgcttgtcgacgaccgggaaacggccctggaccggggaagcgtacgcgccctgaccctggccggccgccacgagccgggaaccgaggcccagcgtcaggccgggttcgatgtcttgggccgtcgccacccgcatctggccggcctgttggcgcgaccggaaatcgccctcattaggctgcaggtcacgtcctatctgctcctgacaggtccgaccgatgccgcctatttgaccagcctcgacgaggcgtccgcaacagaggctgcgggacaggacagcggccctatcccccctgccccacgccggtgatgttgagatagacctcgtcggcttttttggccaccgtgccgtcgatacggcagtcggcatctttcttgcccaggtcgaaaagcttctcgatgacgtccttggaagtcacgtcgtcgcagatgagataggtttttttgtcctttgcttcaaaggccaggcagatggtttccttttggggatattgcttcacgcccgtcacccgtccggtcagggacacagtctcggcggccagggcggaagcggcgcaagccataagcagaagcagcagcaaaaacgcgcgcatcaatcaaacctccttgacgcgacgtcggtaatcggtcgttaccgggataattcgtcgtcatcgccgccgggcgcggaccggcccggggcggcaatgagccacagcacgaggcaggcggccgcgacccagtatagggcgtcctggcgcaggagccagaccagggcgtctcgcggccccccgtccggcaaagtgaataaccgtcgcaccagggcgtcgggcagcacgtcgcccatgggccaggccagccacatcccgtcgcgccacacgacatagagccgcatggcgagcatggcccaaagcgccgtcaggctgaccagcaggcagccccggccgagtgcgtctccagggtgtcgcacgccgccctgcctccttatcggtggccggcagtatacgggcggcgcgccggcctgtaaacgcctgttcgcgcccgcctgccatgcctggataaccgttgtctggcggcctcgccgcctcacgtcaacgtctggacgaggctcctaacattcccggccgcctcatcggcaaaacaatatcagccggggttcccccctcaggccgtttcgggtcaatagcaaaggtttgcgtcacatcctcgaaatgcgcctggggattccctggaaacagataaaacgccctgcttttccatcggatgctgatcagttgccctggggacgcgtcacgaagtcgttttggccagataggccaaggcctcgccccggtcggtaaaacgcggggccttgtcggtgatgcccaggcggtcgagaatgcgcacgaagttttcggccaacccatacacggcggcagggcggcccgaggcccggcaggtctcggccacgctggccagaacgtccagaccagcgccgttgatcgaggcgttgggcgtgaagtcgaaaagcacccccacggcgtcgtcgagttcccgaaaggccttggtcagatagggttcgctttcgccgcagagactgcctcggatatggatgacgccaacggtctcttcacaggcggcagccacgtcgccgccactaccggcggcctcggccatgtccaagcggccgttggcccggccaagggcggcttccagggtctcgcgacggatgggtttgtcgataaaatccgtggcccgaagccccagagcggccagggccaggtcggtgtcgccgtggccggtaatgacgatgacctcggtttcgggccgccgggccttgatcgcctccagcacttgcaggccgtccatgccgggcatcttgatgtcggtgagcacgatgggcggggtctgggcgtcaaatacggccagtccctcctcgccgctggcggcggtcagggttttgtagccgtaggctccaagatagagttcgaacatctgcagggtgggccgttcgtcatcgatgaccaggatggtgcgcatggaaactccaaaagactctcgctagaggcgttgtgcgggctggcgggcacggcgtcaagggccgcgctcgcccctgtcgcgggccacggggaaggtgagccggaaaacgctgcccttttccggggcgctttccacctcgatctcgccgccgtaatcccggacgatgccgtaggtgatggccaggcccagtcccatgccctggccggtctgtttggtggtgaaaaagggttcaaaaattttgcgccgggcagcctcggggatgccgcagccggtgtcggccacggagacgtcgaccaggccgtcgcggctttccgagacgatggtcagccgacgcggccgttcggctgggcagctgatgccggtcatggcgtcgcgggcgttgaccacgaggttgaaaaacacctgctccaggcggttggcatgggccttgatgggcgcgacggcggccagacgcaggaccacctcaatgccttgcagggccagttcgtggccgatgatggtgaaaacgcccttgatgggttcgttgatgtccacatactcgagcttgggctcggatttgcgcccgaaatcgcgcagatggccgatgatggcggcggcccggtccacctgttcgctgacctgcccggtgacggcggccagggcgacgggggacggcaggccgccggtctcggccaccattttgagatagtcgctgcccatcttgatggcgtttaagggctggttgagctcatgggcgatgccggcggacatttcgccaagggtcttcattttgctggcctgaatgagctgggcgtctttttccaccagctcggtgatgtcggtggccgagacgatgaccgcgtcccgggctcggtaggcgatacggcaagcgtggacgttgacgtagagcggttcgccgtccttgcgcacatggcgcagcttgggaaacagcacccgctcgggcgcgtcgcggtcggccagataggcggccaccccgccgtcggcgtcgggttcaagttcggccaatccccggcccaccagttccttgcggccgtagccgtagacggcctcggcctgggagttggcgtcgaggatgcggccggtggccgcctcgaccacgaagaccgggtcggggttgctgtcgaaaagcgaacggtatttttcctcggactcgcgcagccggcggcggtagagccggatgctccagatcatgttgctgaaggactcggcgagctgggccacctcgtcgccgccgccctccttgcggtagaaccggcactcccggcaggtgcgcgaggcggcctggctggtcggctcgccctcgccccggttctggtcgaagtgccagcaaggcaggtcggtgtcggcgtaggcctggcagtgcttgatggcgtcgtcggaaagccccagcatggcctcgggagcgtcgaggcttccccggctaatggcgtcggcggcctgggtcaggcgcgacagcggccgggccacggcgttggacaggcgcaggacgatgagaaacatgaccacagtgacggccgtgatgaagcccagaaatgtggtgcgcagcttgccgaccagggagtcaatgtggctcttggacaggcccacatggaccgcgcccagagtgtagatgccctcgcgcacgggcacggcgatgtcgatggcctgggaccggtcgaaatcgaccaggtcgatgctgtaatccttgttttcgggcaggggattgatgccgcgcaggtcggccggaaagggacgtatgaaggtgttggccaggatgcggccgtcattgtcgctgataaagatatacgagacgaggactttgcgttcgccgagctgggcggcgtcaaagaccagactgacgaggtttggccggtccttgtcgaggatgaatccgctggcccgttcggcgatgctctggccaatggccacgccgcgctgttcgagttcccggttgaggctggtgaccaggatccaacgggccaatatggcgatgacggcgctgaccaggagcaccacggccatggtgccgccgaacatcttgagcttgaggctgacgcgctggggcaaaaacggcatgggatcagccgcccgaagccggagacggggcggcctcgcgcccgtcctgctcgttggggacgaccttgacggcgcgcccggcttccagggcgtccttgatgccggcccagtccgtgaccatgtggaaacggccccggtcaaagcgggtgaaatagacccggtccaggccctggcggcgatccctgccgtagctgacgggactggcgatgcccacggaaaagtcctggatggattcgatggcgtcaaggaagcgctcccgggtgagttcccggccgcagcgccgcaagccctcgaccagcacccgggcgttgatgaagccctccaggccgacaacatttggccgctcgtcggggaaggagcgggcgagcaggcgcgcgtagtccatgacgcccgttaaaagcgaagtggcctcgggcagatccgggggcggcacgacctgggacatgaccagcggcgtgtcgtcgccgggaccgaggatgcgggcgatttcgtcggcccccacaaaggacacggcgtagaaaagccctttgtagcccctggcccgggccagcttgatggccttggcgcagggaccgtaggccccgatcatgacgatggcctggggcttggcctccaggatgcggcccacgccctcctccacgtccatggagccccggatgtaggaaccgcgcgccaccggagccaacccccggtccttgagcgccatctccgtgcccttgaggccgtcaaagccgtaggcgtcgtactggtagaacacacccacccgctccaggcccagatcctggacgagatgctccacggcggcggcggtttcctggtagtaggaggcgcggatgttgacgatgtagcggcggaaggggaagcgcaggaggtcggcgccggtgaagctgccgaccaggggcacccgggcttcctccaaaagcggaatgatcttggcggtggtgggcgtgcccacgtagctaaaaaggcaaaagacctggtcctcgactatgagctgctgggtgttggccacgcagcgcggtggatcgtagccgtcatccagagtgatgagcttgatggtccggccggccacgccgccgccctcgttgacggcgtttaaataggccagcgcgccgtagagggtctgcttgccgaggtagctggcgtgtccggtgagcggcagggaacaacccacgaccacggtgttgccggtaacgcccggcgatgctgccgacccggcgtcgggcgaggacggccccgaacaaccggccaggaacacggcagcgacaacgagagccgcaatccgcaagcgccttggccagacaaaaaaaaacgggctgcgcatggtggttgatagcagacagggggcggggttggtcaactggggagggcctccccctggccaggggccaagttgattttcccgaagcgtcaggacggggtcgggcaactgaaggcggtatcaccccttccctgcccggacaggtccggcgcggacaatccgccgcatccgggaggccgtggcagcggcctcccgaagcggacggttgcgggaacctaaccgaaggcccgaagcgggcgcatgaccttggccaggaaggccttgcggctcaggggccgtgggccggcgtctccgaactggacgtatttatagtaggcgctgggcgggaacggggtcaggaagatgacccgcaccgaatcggcgtccaccagttcggccttggggaacttgggtttgagtttggccagacggtccttggccagggccagcatttcgtcgcgatcgccgaagttcatggtcccggtgggacaggtctgcacgcacgagggcagcaggccggcatgaatgcggtcgttgcacaggtcgcacttgtacatgagcttggtggccggatcgacccggggaatgtcgtaaggacaggcctcacgcacgccgccggcggacaaccccttgcacttttccgtgaagaccacggccccggtctgggggtcctggacgatggcgtcgggcacttcggagtcgcccaccatcttgcacggcgcgtccaggcagtggcggcactggtccgggaaaaacagccactggaacttgccgtcaatggttttctcggaaaaccgcagcactttgagcgtctgccaggacagatccggcggattctgatgggagccggtgttttccgtgggttccacgggtttgttcttccactgcttgcaggcgatctggcagccccgacagccggtgcagcgcgacaggtcgacaaagaagctctttccagtcatggcgtcggtcctccctaggccttgcgcacgttgaccatgaaggccttggtctcggggatgcccgtattggggtcgccgaccgagggacacaggatgttggccgagtcgccgccctgcttgggccaggtccagccgtagtgccaggggatgcccacctggtggatggtctggccgagcacggtgaaaggcgtgatgcgctcagtgacgatggccttggcccacagcgaaccgcgagtgctttcgaggatcaccttctcgccgtttttgatgccgcgcatcttggccagctcggggctcatctcgcagaacatctgcggttcggcttcaagcagccagggggagttgcgggtcatgacgccggtctgccagtgctcggtgacccggtaggtggagcacacgaacgggaagcgcgggtcgcaggaagcgtgcacttcggtggggccggtgaacttgagcgccgtggggttgtgcagctgcttggagaacgggttctcgccgaccggacattccaggggctcgtagtgttcgggcagcggtccgtcgttgcggcccgggccgaagatgaggcccatgccctcggtggtcatgataaacggcgacttgccgtttttctgatcggccatgggcggccagggaccgtcgggcacgtcgcccacccacttgccgtcttcccaggcgatgaccgccttttccggctggtagggcttgccctgggggtctaccgaggcgcggttgtagagcacccgacggttgaccggccaggcccaggtccagcccgggaacaggccgatcttggcctgcatggcggtctgcgtcttgtcgcggcgggcggccatgttcttgtcggtgtaggaaccgcaatagacccaggtgcccgagcaggtggagccgtcggtctgcagcagggcaaaggccggcaccggatcgccgggcttgaaggtcttgtccgcgtcgcccaccttcagggtcttttccttgaggaagtagccgttgatgcgcttggcgactttgtgcggatcgaagatgtggttggtggccacgtcccagttgaggttcttgatgggatcgggataggcgccgccttccttggcgtacagcccgcgaatcttctcgaagagttcgtagatgatgtcgccgtcaggcttggagtcgcccaagggggcctgggccggatagcgccactgcatccagcggccggagttggagatggagccttccttttcaaaggacacggcgcagggcagatagaagacctcggtcttgaccttcttggggtccatgcccgggcccttccagaaagagccggtttccgtctcgaacatgttgaccgtgaccatccagtcgagcttggtcatggcctcgcgggtcttgttggcgttggcggtgctggcggccggattctggccccaagcgaaaaagcccttgaaagcgccgccgagcatggcgtcgaaaagcgacagccatgagtagtccttgcccggttcgagcttgggcagataggtgtagccggtgtcgagatcctgctcggggtacatggacttgataaagctcgccatgtatttgggccggttgccccaccagttggcgctttgcgggtccttggtcaccggggtgttcttctcgttgtactcggccagggtctgcatcgccgccgagggggtggggatgtagccgggcagaatatggaagagcaggccctggtcggtggaaccctggacgttggcttcgccgcgcagggcgttgatgccgccgccggccacgcccatgttgcccaacagcaactggatgatggacatggcccggatgttctgcacgcccacggtatgctgggtctggcccatggcgtagagcatggttccggacttctcgggcttaccggtggcggcgtaggtctgatagaccttttgcagatcggccaccggtgtaccggtgatggccgagactgacttcatgtcgtaacggtcgtagtgggctttaaggatctggaagacgcaacgcgggttgttcagcgtcggatctttcttgatctggccggcgtcgtcacggacaaagctccagctcgacttgtcgtaggcccgcttttcggcgtcataaccgctaaaaagtccgtccttgaagtcgtacttgtcgcccacgataaacgacgcattggtgtagttgacgacgtaatctttgaaatacaggttattggccaggatgtaccggataagacccccgaaaaacgggatatccgaacccgagcgcaaccgggcgaacacgtcggcatgctgggaagtgcgggtgtagcgcgggtccacgtggatgatggtcgcgcccttgtccttggcccgcagggcccacttgaaggagatgggatggttctcggcggcgttgctgccgataatgaaaatgcaatcagaattggcgatgtcgatccagtgattggtcatcgccccgcgtccgaacgactctgccagagccgctacagtggcgctgtgtcagatacgggcctgatgctcgatgtaacttaatcccatggcccggagcatggcctggtagatccagcactcttcattgtccatggcggcggaaccgaccgaggcgatgccttcgcagcggttgaccacccggcccttggcgtccttggtcgtaaagctgccgtcacgggcttccttgaccttgcgggcgatgcggtccagcgcccaatcccaggatttttcttcccagttctcgctgtacggggcgcggtagagcaccttctggatgcgacggtcattgttgccgagctggtagtgggacgcgcccttggggcacagcgcgccttcgttgatcggatgatccggatcaccctcgatattgaccaccctgcccttgccgtccttgtccgtgctgcagatcagcccgcagcccaccgaacagtagcagcacaccgaggtgctctgtttagtgaacttgagcttggccgcctgcccctcggcgtaggccgggcgcagatcgaagccgaggccgccaaaggcggtcacggccgtggtcgcgcctgcgattttgaggaactctcgccggttccattccatggtccgtctccttgccgctaagcgttctcaccaatcccgccgccaggcttgcggcgtcgggctttgacccgttgcgttatgctaaaattagcataagttaaaaataacataggcataaatgcgaagagtcactttctctgtagaaagcggaacaaaacgggtcaaagaataattaattagttaaggtctggcaccaaggagacgatataatcgagcaaaatcggtaggatgtcttgatcgcggtggttgtagcggaactccagttccttgagatacagcggaaatttccccgccgtgaccccatggaaccggatgaggcgttcccgggcgtagggccagaagcccgcctggcggggatcgacggctggggcgcggcccgcgacctccaccagatgccgggtcagaatatccgaaccgcaggccaccagggcgtcgtagcgcaagtagcggtcggagtagacgatggaacccaggcgggaaaggggcagcgagaagttgcggttgaaatggagcaaatcttccgggccgaggtttggcaggtagtcgataaaaaccaggccgccacgctccaggatgccgaaaatgggcacggcggcaagttgttcgtccgggccggccggccgcatgttccgggcggccgagcccagttccgcaccaagggggcttcggaggatgtcgcggccgtcgaggctggcggcaagaatagagagccgggccacggtggcggccttgtagacggtgttgtaggccagccccagggcggcggccatggcgtgggcggtctcctcggcggcgaaaagggtgagcaagcgcagccagtggcgcggagtcagcccagccagtccggcgaaacggccggacagggcatgaaacgtgtagcggcaaccggcacagcgcacccggccctcagccagggcataggccttggtgccggcgcagcgcggacagacgggctgggcgccgggccaggcccggcgttccaggaacttgcgcgccccctcttcgctacgcagatggcgggtcaggtccagggccatgaccgcgcgcccttagtgccgcattcgcgccgttgatgggtcatcatgtggcgctgccttttcttgggtatcgcccggggagcgtcagccgccgatggccgacatgccgcgcgtcttgccggccgtgccgggatcgagcacctcgtagcccagcggtttggtgcgaagggccagggcgatgacccggcgcacggcggcaaggcctagagccggattgcgcagcatggcccgcagccggtattccttggtggaaaacaggcaggtgcgcagcttgccgtcggccgtgatgcgaagccggttgcaggtgtcgcagaaatgttcgctgagaggcgaaatgacgccaaagcgtccggccccgccggcgatgcgatacatccgggcagggccgccggtggcgcggtcgctgtcgtccgggacaaactcggccgcacgtgaggccagctccaccacatcctgggccgagatatagttctccggccgccagaggttgccgtcgccaaccggcatgaactcgatgaaacgcacgtcgatgggcgatttttcggccatggccacaaaggccggaatttccgccgtgttgatgccacgtagggccacggcgttgatcttgacccgaatgccggcctccaggcactcgccgatgccctggagcacggcggacaaccggtcgtggccggtgatgcgggcgaaggtggcctgatccaggctgtccagggaaatgttgacggcgctgaccccgagcttggccagcatggccgggcggccggccagcagcgtggcgttggtggtgatgcgcagatccatttccgggtagcgctcccggatggaggcgacgaaactcatgaagtcgcgccgggcaaagggttcgccgccggtcaggcgcagcttgacgatgcccatgtcccgggccaggcccacaaggtcgagcatctcctcgtagcgcaggatcttgtcgtggccaatgaacgtgaagctttccttgggccggcagtacatgcaggccaggttgcagcggtcggtgacggaaaggcgcagataactgacggcgcggccgcgcccgtcgcgaagggccttgcccgatgtgccggtcatgccccctcctccatgccgcgtgcccggatgaggtccggcggcgaattgacgttgaaaaaggcccgggccacggccggatcgtcgcggctgtagtccagatggcgacgcaggggttcgggaaagatggccgagagccggcgctggccctgctccaggttctcccgcaacagcggcagcccggccggatcgtagatggccaccagcgactccacgaagccggtctcgacgatgcggtaggtggtcataagggccgtttccggccgatcgcgccaggccgcaaccagacggaccagggtttctggttccagaaacggcaggtcgcaggaaacgaccaggcacggtcgggtggccgcggccaggatggtcatgaccccgccggccggccccaggcgcggcgtttcgtcggggagccaggggcaggcaaagccgaacggggcgggatcgcgcccggaaaccatgatctcccccgtgaccgcggccagcacctcggccacgcggcgcagcagcggctggccaaaaaaggtgagccaggccttgtcccggcccatgcggctgctcaggcccccggccagcaccacgccgagcggcagttccccgcccgccttcacgcccccacccggccggcggcgtcggtaaagacggtgaaacgctcctccgcgtcccgggcaaagccgaccagggtgacgccggcgtccttggccgcgccaagggccgctccggtcacggccgagcggctgaccaccatgtgcagcccggcccgcaaggctttctgcatcatgctggccgtcacccggcaggacaggaacaggatcagctccggcaggcaaagtccctggcgcaggccctgcccggccaaccggtccagacagttgtggcggccgatgtcctcggcccgggcgataaaatttccggccaggggatcgtagagcgcggcccggtgaaaacagcccgtgccgtcccacagccccggctcggcgataaatcgccgcaccagggccaatagttcggccgccgggagctttcccggccgggtcggatcaggagccggccggccgtccgggacggctttcagggaaaagctcaagccctgggcgtcggtcaccaccgggatctcgcccggcccgagcatgtccagggcagcatggcccagaaccagcgcctcgggatcaaggggcgcggcgtagagcgtttttcgccccacgccgtcaaggtccagggtgacccggatctcggtggccacgtcgtcgaggatgtcagtgaaagagccgtcccggtagcggcggcaggggacggcgcgggtgagctccggcagttccatcaaaacccccaggccgacagcaccggccggttgtagccctggccccgggcggccatgtccagggtcagggattccaggtcgtccaggaccggcacgcttggccggtcgaactcccgaaaatcgacggtcttgatgtaattcttgcagcgcaggcagacattgacgaggtagcccggctcctcggcggcggtgaaggtttccaactgcttggtgtcttcctcgccgcagtgcgggcacatgagacgcttggcccggtattcgagctggcaaaacgagcaggtcagatgcctggccccttccttgccgaccagccggccaataagcggcggactggcgcagaccggacagtgaccaaaagcccaggagcggtccttggggaaatgggccatgaccgcctcgccgacggcggccagacgcggggccagggcggcctggaccagaaaggcgagcaggcgcggcgcgccgggggtgcgctcgccgtaagcggcgaaaaaggcgtcgtcgccggccagatgccggcccacggccttggccatgtcaagggttccggccgcgcggtcggcttcgagcacggccagggcctcggcaagatggccatcgccctggcgcaccaatccggaaatttcggccaacagcgcctcgaaccggtccatgtccacggggaaggcgtcccggggcaaacgcggcgcgccgcgcaggttgcgctccacatcggccaggacagccggatccacggtcacgtcctccttggcccgggccgcgagctggacccgggaggtcgccgccacaagggacagcagggaagccggcaacacggtcttgcgcgacagggaatccagttttttctcaagcacttttgaagccttatcataatcaaagggcatggtgtctccttgggtggcccggggctttcgccagggcctttgcggcattatggtgacgcaggcaggacttggcaagaagcggcgctccgacaggagccccaaccggccttgacgccggcctggatcgtccgcactgtgcccaatgtttttggtatcggcatggccgatgcccggcgcggccccggctgtcaaggccgaggtcgcaacccatctcgcggaggaagcatggcgctttggacccagctctttctcgctccttcggcgctccaggccgtggtggtcatcggcttggtcgcggccaccggcttggccctgggacgcctgcccgtggccggggtgcgcctgggcgtgggaggcgtgcttttcacgggtcttgccgccggccactttggtctggcccttgatcggcatgtcctggaatttgtccgcgaattcggcctgatccttttcgtctacgccatcggcatgcaggtcgggccggggtttatcgattccctgcgtcgccgggggctgcggctcaatctcgtggccgggggcatcgttatcttcggggccgctctggccgccgtcttccatctgctcgggcttttccccctgccagtggcggtgggcgtctacagcggagccgtcaccaacacgccgtccctggccgccgcctcccaggcctttgccgagctggccccggcccaggccgaagccctggtcggccaggccggcctcggctacgccgtggcctaccccttcggcatcttcggcatcatcctggccatgctgaccgtgcgccgcctgtttcgcatcgacccggcggccgaaacacggcagttggaaacgctcttggccgaaaatgccccgccgctggcttcccgcaccatcgaggcgaccctgcccgccgcctttggccgcctcctcaccgaacttccggccatcgccgagggcggggcggtggtttcacgggtcatggccggcggcgtggtgcgcccggtcagcgtcgatacggtgctggccccggggatgctcgtccacgccgtgggccgggtcgaggccctggaggcgctgagccgggagatcggccaggacagcgaccaggacctgcccgccctgcccgggccggtggaaacgcgctcgtttcgggtcacccgggctgccgccgtgggccgcaccgtggaggctctgggccttggcccggaccacgacgtggccgtcacccgcgtcacccgagccggcacggagttctcgcccggaccgggcgtggggctgcatttcggcgacacagtgcgctgcgtgggcacgaccgaggccctggcctttgccgaggcgcgcctgggcaactccgcccgggagctggccacaccccatgtcctgcccatcttcatcggcatcctggccggggcggtcctgggcggcattgccgtgccgctgccgggactgcccaccggcgtgcgcctgggcgtggccggcggtccgcttctggcctccatcctgctctcgcgcctgcaccactttggcgggctggtctggtatctgccacaaagcgccaacctgctgttgcgcgagatcggcatctgcctgtttttgtcctgcgtgggcctggccgccggcagccggttcgtggccgccgtggggtccggccagggcttggtctggctggcggccggcgcggccatcacgtttgtgccgcttttagccgccggcgttttcggccggatgcttctcaagtgcaactacgcctcgtcctgcggcctcttggccggggccatgaccgacccgccggccctggccttcgcctcccagatgcttggcggcgacgccccggcctcggtctacgccacggtctatcccctggccatgatcctgcgcatcgtcaccggccagctgctcgtcctgaccctttttcccggctgacggaggatacgccatgctccgccttgtgtgcgccctgctcctttgctcctgccttgccgcctgcgaccgcgtgccggtcaccgagcgcaagcagttcgtgcttatttcggagtcccaggaacggaccatgggctacaacgccgcccggcaaatcctgcgcaccgagccgctgttgcgtgatccggccgcccaggaactggtgaaacgcgtgggccggcgcatcgccgccgtgtccggccagccggactatgactgggaattccacgtcattgacaacgaccgggccatgaacgccttctgcctgcccggcggcaagatcttcgtctacagcgggcttttaaagcaggtcaaaagcgaggacgagctggccgtggtcatggcccacgaagtggcccatgccctggcccgccacggcgcggaacgggccaccctggaaatgggtgcacgcctgggcggggcgctgctccagctcgcccttggcgacgaggacccgcgcatcgccgacatcgccggccgggtctggggctacggggccaacctcgggctcatgctcccctacagccgcaagcacgaatacgaagccgacgccatcggtctggcgctcatggccaaggccggctacgatccccaggccgccgtgaccttttgggaagggatgcgccgggccggcggggcaaagcccgtgcttgcctttctctccacccaccccacggacgaaaagcgcgtggcccgcatccgcaaggacatcgaggccatgagccaaggccaagccccggggaagtcatgatcccgcccgatctgcccgccccgccgacggcaatttgcgccgcctaccagcgcatcgcgccctggtttatggccacccgctcggcgaccgatccgcccatggaagcggcctggctgcggaccatgctcgccatgctcgccccgggcgaaaccgtcctcgacctcggctgcggcatgggcgaacccctggccggctattgcctgcgcgccggacacacggtgaccggcatcgatggcgcgccggccatgatcgccgcctgccgcgagcgtttcccggccatggactggatcgttggcgacatgcgcggcctggaccttggccggagcttcggcgcggtcctggcctgggacagttttttccatctgtcccacgacgaccagcgggccatgtttccggtctttagcgcccacctccggccgggcggaacgctgctgtttaccagcggcccccatcatggcgaggccgtaggcgttatggacggcgtcgccttccggcattgcagcctgtcgcccgacgaataccgccggctcctggccgggcacggtttcgccgtcgaggatcatgtcgtcgaagaccctcactgcggcggccacaccgtctggctggctcgcaaggagggctgagcgcggtccgaatgccgcccatcctcttgccggtcaggcccggtcccgttaacacatgtcgcatgctgcggattactacttgcgtttcaaagccaagcgctcccctagcggcctggaaccgtcgcggcccttgggccatgtccctcgcctgaccatggcccaagggcacgcccctgacgtataaggaacaactgtcttgaacatccgtttcctcggctatctcgctgccctgtccgccaccgtgctgtgggcgggcaatttcgtcgtcgcccggggcatcgcccaggaaatcccgccggtgcagctcaatttctggcgctggcttttggcgcttgcctgcatcctgccctttgcctggcccaagctgcgggccgactggccggccatgaaacgccactggcgctatctggccgccatgggcttggtcggcgtctcgttgctcaacgccttcgtctacaaggccgggcagaccaccgaaagcctcaacatggccttgctcgtgcccaccgccccggtcatgatcatcattctgtcacgcatcgtctatggcgaaccgctgaccccgcgccgcctggggggcgtggccatcgtgctggtgggggttttagagctggtctcgcgcggcgactggagccatatcgcctccctgcgctttctgcccggcgatctctgggccttggccggagcggcctgtttcgccctgtattcgcttttcgtacgcaagcgtccggccggcatctccgtagaaggcttcaacgccgccaccttcgcctggggactcgtcctcatgctgccggccctggccgtggaggccgccgccggaccgaccacgtcctggaacctacgcgttctctccggcgtggcctacgccggcatcggctgttcctttgccgcctacaccctgtggaccaaggccatcggctccatcggaccggtgctggccggcatcgtctattatttcctgccggtggtgacggccgtggagtcggtctggctgcttggcgaggccgtaaccgctgcccacgtgctgggcggggcgctcatcgtctcgggcatcctgctggccaccctggacgtgcgcttgctgtccgtacggcccgggaaaaccgtgtagaccgggattgcccttaagaaccctgccgccgagcgaacaaggaaacacgccatgacggatgtctgcagccagactcgccgaggcaacactatcgcggtcattcccgccaggggtggcagcaaacgcattcctcgcaaaaacatcaaaccgttttgcggcaagcccatcctcgcctattccatcgccacggcccgggcgaccggccttttcgaccatatcgtggtgtccacggacgacgaggaaattgccgcagtggcccggcagtggggtggcgaaaccccctttctccggccggccggactggccgacgattttgccggcaccaacgccgtggcggctcatgccgccgagtggtttctgcagcagggaacagccgtggctcatgtctgctgcttatatgccacggcccccctggccacgcccctttatatcactaaaggctttgaaattcttaaagagcgacactgtccctttgtcttctccgtcacgacgtttcctgcggcggtccagcgggccttgcggcttgatgcccagggcagggtttcggcatggtatccggagttcatgccgacccggacccaggatctggaggaagcctaccacgacgcagcccaattctattggggctcgcccgaggcgtttgcccgcctgtcgctgttcgactccggttcttccgtggtgcgattgccgcgccatctcgttgcggacatcgatacgcccgaggattggacgttggccgaatgcctgtacagaacccttgtcgccatgggagagatagcggtttggtaacaaagcccgggggacgccatgttcgcacatgatgcaagggactccgttttggtcatcgccgcccatcctgatgacgaaacgcttgggtgcggggccacgatagcccgcctgaccgcgtcgggccaggatgtgcatgtggtcttcgcggccaccggcgccgccgcacggcatgatgccgccgagattgccagcgaagccgtcgcgcgcgaggtggccgcgctcaaagccgatgcaggccgtgcaggagccgtgctggaagtcgcctcccaaacttttttggattttcccgacaaccgactggacacggtgccgcttatggacttggcccagagcttgaaacaacttgtggccgaccttcggccgggcatcgtgtttactcatcacttcggcgactacaactgggaccacggccgcgtgcacgaagccacgctcatggcctgtcgggccaatcccggggagttttatccgcgccacttgtacagctacgaggtgctctcctccacggaacggaccttgggtgctccccaccgcctgttcgcccccaatgtgttcgtggacgcgaccgccaccctggaccgcaagatcgccgccctgcaatgctatgcctcggaattgggcgtctacccccacccccgctcccccgaggcggtgcgccagttggccggcgtacgcggcagctcggttggcatccattttgctgaagcattccagctgctcagaaccgtccatgtcacctaacgacgccacgcacgactcccccagggtgggggcttccatcgcttccagccgggagagcccatgattgacaaggcgaaaatccaggcagccatgcaatattacgggaaagcctacgtggccttggcggacgtggcctcggcctgggaacgcggggaaaaacccgcagacgcttttttcaccctgaaaaatctgccggtccgggtgttcgtggagccgacgaaccgctgcaacaaacgctgcgtgtattgcgccaggccaaacatgacgcgccaatccgcctcgctgactttggatgacttcaaacgcgccgtggacgacattgccgccggggcctttctgcaatgcaccggcaatggcgaacccctgctcaacccggacaccccggccatgatcgcccacgcccgccaaaaggggctcctggtcggcatcatcaccaacggcacccggctgacggcaaaactatcccgcgcccttatcgaagccgggccgcatcaagtccagatttcctttgacgcggtagaccgcgacgttttcaacgccagctacaactcccccaggggcggatgcagctacgaggcgaccttgtccaagattctccggttcctggacatggagcgccgggaatttcgcaaaggcatctttgtcagcatcgcttcggtgctcaccgacgccgtccgctccgtgcgggagacatcccgtgcgtattgggaaaggctgccggtggacaattattttgaagcccccctgctgtccctgcagaccgactccggcacggcccatctggcccggacaggggaggagccctggaagctgtgttcaaatccctggaaagccgtgaaggtcaatgccgacggcacggtcaacccctgcgtgcacgatttttccagcaagtacgtcattggcgacatcaagcaacaaccactgcgtgagatcgtgaactcccccgcagccgttgctttgcgcaaggcgctttattaccaggacatcgattttttcaaagccattgggtacaactgccaggactgcaatgtctggagccaggcgacaggccacgacgtgcgcggctatctcgacggcagttttcctgtcacctacgggctgatcgtcagccaactggcaggctgtgcgtcttatgcgcctgagaaaatggaaaatctgcgtcgagctgcgtcagaggcctctggcgcgctctcggggatgtaacccatgccgcattctcgtattcgcatagacgccgcccatgagatcggtccggaccggacctttgtcatcgcggaggtggggtccaaccacggccgggacctcggcaaggccttggaaagcgtggacgccgccgctcgttgcggcgtggatgccgtcaaattccagtccatcgacctggatgccctgtattacgcgcctgatgacaacgttcgcgccctgcacgcccgcatcgatttcgaggaacgttggcacggggaactcaaggccgcctgccatcgccgcggcgtgctcttcgtgtccacgccgacgtatttgcgggccgtggatgttctggaatccgtaaacgtcgccctgtataaacttgcttcggcccaggtcggcgtctttccccagctggtcgcccgggtggccgccctgggcaagccgaccctgatgtccgccggcctggtcacgcccggagggttggaggcgtcggtggacgcctttcgccgggcaggcaacgacgactacgccatcctgcattgcaacgcgatctacccgacgccgcccaaccggacacatttggcccggatagaactgttgcgggccttgtatggatgtcccgtggggttttccgatcacacccaaggcatcgccgtggcccttgcggccgtggcccgtggggcggcgatcatcgaaaagcatttcaccctgagtcgcggcctggacacgcccgatgcctttttttctctggagcccccggaactggcctcgctggtggccggcatccgggacgtggaagcggcttgcgcgccctgccgggcgcgcctggccatcgaaaccgaggaaagcgccttcaaggaatccatccgctaccggctggtccttcgcgtggccaaagccgccggccaagcctttgccccgggtgatttcgactacaaacgccacaacgagggtgtggattgcgtcgaagaggggctggtgctggcccggatgcaggccaggggcccgctcgatgccggagaactgctgcgctgggagatggtggaggggaaagcgtgaaacgtgttttggcgatcaacctcggctgggagcaggaaccgctccttgatctgctcggttcccttaatctggaaatttacggcgtccatgccaacgacggctactacaaaggcatccgctatcacgacctgctcatcgccgccccccgggatttgcccaggctgctgctttttgctcaaaaggtccggcctgacgccgtcatttccgaccaatgcgactattcccagttcgcccaggccgtcatcgcctcgcgtctgggcctgcccggccccagcctgcgcgacgcccagatcggcaacagcaaactcttgcaacgcaccctcggctggcaggccggtctgacctgtccccgcttcacgctttgcctcgacgcccaggacgtgctgcgtttcgggcgcgaacacggctatccgttgatcatcaagcccgtggacaatcgcggcagcttcggcgtcaatcgggtagatcgggaaagcgacgtcctgcccgcattttacgacgcgctgatccacagccattcgcgcggcgtattggcggagacctttatccagggccggcatttgaccgtggacggctacgtctttcaaggacttggtccccgcacgctggccgtggccacaaaaaccaaactaccgcagaaacagtccatcattgacggcgaaatcacctatcctggagaattgccgcccgccttgtacgacaaggcgagcgccgccctggaacggaccgcagcagctctgggcttcggcttcggttttttgcacggcgaatttatcctcaccgacgcaggcgaggtgtacctgacggaaatagccaatcgcggcggcggggtgttcacctcggaaatcattgtgcccaatgtttccggcatcgacatcctgtctgtctacgtcaatgattgcctgggcacgcccttgctccccataagcggcgatccgaaccaccccggccggacccccacggtgatgcagttgttcgccttttccgatctccaggaaggcatcgtcaaaaaaatcagcggcattgacctgctggaagcccgagaagacgtcttgcggctcaagatgcttatccgacgcggcgacgtcgtgcgcggcattgcttcgggcgccgaccggcatggcgtgatcatcatgaccgcaccggagccgcgggagttgaaaagacggttaagcgaagccctggccatgctgcaggtgaccattgaaaaacgtgacgcttcttgagtgcaccttgcgtgacggcgcctacaaagtcgatttcatgatcgaccaggagacctgttgtgctttcgccgagaagctcgtccgcatcggcttccaggatatcgaagtcggacacgggctgggccttggcgcataccggcagtattcagccggttttaccgatgaggcgctctataagcgccttgcgcctctggccgcgcgcagccgcctctacagcttcttcatcccctctgtaggcaagcccgacgattttcgcatggcccgtgactacgggctttacggcctgcgcgttggcgccgaaccggtttacgtcctggacagcattccaaccctggaagcagccaagtccctgggctatttcgtggccctcaacgtgatgaaaagctacaccgtcacgcccgacggctttgccaagcttgtggagaccgtcaaggatttcgtggatgtgatttacctggtcgattccgccggccacatgttgcccgaggagctgcgggcctatgtacgggccatccaggaccgcgtcggcatgatcgccttgggctaccacggccacaacaacctgggactggccgtggccagcgccctggaactgctcgatgagggcgtgcaatacatcgacacgaccctgaccggcatcggccgcagcggcggcaacatccccacggaaaccatgctggccgtcctggccaagaaatacggcgtccaatactgctcggacgattttctgctgcaaacgctaggcgttgcccgccagtttcgagaatatgtgctgtccaagggcaagtcgctggattttcgcagcgaggacatcctgttcggctacgccggtttccactcgtcctacgaggatctgttgcgccgcgaagccgaacggcaaggccaggatttccaccaggccatcctggatgtctcgcgacgcgaacaggtctgtctgaccgaagcgatcctgaccgatatttttcgagaaataagcgcgtcgcaggcaaacgcagcctgcaagccgcgctcgtaaaaaggacgcctgatgcgggagattccccaaagcatcgcggccaacatggtgcaacgttataccaagcggtatcgcgatctcggctatcatgtccgcacgcttggctggggcaacgtcgaacagcaacgacgccgttttgccatgaccctgaccctgggcctcgacttgaccggaacacgagtggtggatttcggctgcggcttcggcgattattacgatttcctcaaggatgtcggggtgtcttgtgacaactacctggggctggacatcaaccccgatttgctccaagaggcccgggcgcgccatggagacgatccgcgaaccgcctttgcccaggtggatctcgcccggaagcagtccggcgaacctcttggcgatgtcggcgtcatgctcggcgtgctcaacctcaatttgcacgacgccttcgacaatgaaacgtactcccggcagttgatcacccgggccttcggcctcgtgcgccaggccctgatcgtggattttttaagtgcccgcctggatcccggctatccccgggaggattttgtctactatcacgacccaggcaggattctggatttcgccctgtcgctgaccccggacgtggtgctcaaacatgactacctacctttgccgcaaaaggaattcctgctgctgttgcgtaaaaccacatgaatattttcgattgcaacatccatttctccctcttgggggctgtggaccggccgcatctgaccagtgacgagacacgcatgggaccggccgatctggaggcctgcttcgacgtgcagggcgctgccatccaagcggcggtgcgcgccgccaacttcatgctgttcaatcaagagctgtttttcggtgacggattggacggattcatgggaagggttcgacgcgccctgcccggctccaccttcaccgccttgatcgattttcgccgacaagacgccccgaacgccgtggccttggccgccgcccagggcgtacgcgggctcaagttccattcgtacttccagcgtatcgccgaggaggattttccggcggccctggccgtggcgcgtcgcgctcaggacctgggtttatttgtttgcgtggacactagttacggcacgtcaggcatgtaccgttacgacaacctgcggctggcctgtcttttggccgaaatgttgaccgtccccatcatcttgctgcacagcgggggccttcgcgtgttcgaagccatgctccttgccgaggatcatgaccacgtgtatttggaaacatccttttccccgcattattaccagggttccaccgtggaggacaatttccgctgggcctatcgcaaactcggcgcgcacaagttgttgtacggttcggaccatccctatctcggcctggagcaaagccagcgccatatgcgactttttctggaacattgccgattttccccaacagacatcgccgccgtcttccatgacaacgcccacatcttgttcgcctgaggccacccatggatattgtctttcgacctgccgccccaacgccgcaagatgccgcccgcgtcctcgcctggcgaaacgatcccgtgaccttggccatgttctaccatcaggagcccaaggtctttgccgcgttctggccggaataccttggcgagtatttcaagcatggcgatctgcccccgctgtttgccatggtcgatggacacgaggcggcatttttgcgcagcaatccctatcctgacggaccggtcccagggcggtgcctggatatcgatatcaacgtcgttcccaatcggcgcggacagggaatcggtacggccgtcatccgggccatggcctgccgccttctggaggcgtgccaatgcgtggtggccgaggtcaaatgctgcaacaccccttccctcaaagcgtttcaacgcgccggttttcgcgtccatgaccacgcaacgcatctggtcgccgagacgggagaaatcgtccctatcgtgcgcctgacggccatgcgggctcagttgtcaagcctgcgccaagaagatcatgctgtactttgattttgacggcgtggtggcggacagcgtgccggccctgcactccatctactcagatttcttaatattttacgatattacgccacaaccgggcgaattcgagcgtctcaacggcccctccctgcaggaaatcgtggcctgtctcaagcatgtccatggattgcctggcgacgtcgaggacctactggcccgatacgaggctttgcggcgtgacgcctacgctaagcggatcaaaccctttgcggatgttgcacgggtattggacagcttggccggggccggccagacgctccatctggtcaccgcttcggaaccgggaccggtgcgagacttcttggcgacgtggcggctgaccgaatatttccgggaagtggtttgcggcaatgccgtggcgcgagccaagccggctccggacctctacctgctggccatggagcgcagcgaagatgtgtttgcggccggcttggccatagaggattcggtcaatggcgtccgatcagccgtgtcggccggattgcgagtgtttggcgttcatgcgcaagccacggttcgggcggcgttgaccgaggccggggcttggcgaaccgcagcttgcctgggcgatgcgctgccgacactgggggcatggtgagagccgacgcgacagtgctcgcccggggggaggtcacggtacggctggcgacagctccggacctgactgcacgaatggccgatctggaaccgaaaatagctgcagcctgggcaaaggcacgacaggagcaaccatgtttgtacgacgcccccgtgccgcattttctggagcttaaggaagaaggaacggggatcgtactgcgggcggccgtcataggctttcggcagttgcacgcagcgcggtgccatccggaatgggggcttggcctgacccccattggcattaacggcacgacgttgaccaaggacgggcgcttggtttttgcccgccgggcggcctttgtctcacaatatcccggtctgtgggagctagccccatcagggcatttgagcccccccttcgggttcttggggcaatggaggcacgagcctgacttgctggcggaattcgaagaagaactgggcttgaagcgctcacgggtgacggcagtgctcaccctgggggtgctgcgggacaatcgatcacccatgctggacatctgttgtttgctgcgcgtcaacgctctggccgacgaaatccagtctgccatggtcgccctggccccgcggcaggaatacgccgaggcggcatttgttccgctggaccaagcgcaagcttttgccgccgccagggaactgacgccctcgacccgctccctgctgacattgctgcccaaagcttgagcagccaatcagagggtcttatctattgccctctcaacaacgactttaagttcatctctctccaccggcttcgagatatagccatccattcccgccgccagaaacagctccttgtcgccggtcatggcgtaagcggtcatggcgatgatgggtatatgggacttctccccaaggtccgatgaccctctgatggcctttgtcgcttcgacgccatccatcacaggcatctggatgtccatgagaaccaggtcaaagtcctgttcgtgcaggatggccagggcctccctgccatccggggcggtcgtcaccgaacagcccattttgtgcagcatccgctttccggcgaacaagctgaattcgtcatcctctaccaacaggatgcgcaacggggtttcagccggcccgtcggcctgacgcggctgctgggctgctggttcctgatgcgggacaggaagtttgaacggcagggaaacgtaaaccgtggtgccgtttcccgccgtgttgtcaatcaccatctcgccgccgaggattctgaccagcttgcggacaatggccagccccagccctgccccctggtagcagcgggtatagctccgctcgccctggacgaatggttcgaaaatgtctttgagctgctcatcggaaataccgatgccggtatcgctcacggcaaacaacacccggacagccccgctattcttggccggaagaaccatggcgtcgacttggacagaaccgctttccgtgaatttgagggcgttcccgacaagattgaacaggatttgccggacacgcgtttcatcgccgatgagcatgggcggcatttgagcatcgacatgaaaatcaaaagccaggctcttttcccgtgccgtggggcggaagatttccatgatggattcctggaggcaggccgtgaaaaactccgcttcgatgatctgcagcttaccggcctcgatctttgaaatatccagaatatcggcaagcagacgggtcagccgcttcgtcgacttgatcgcccccagaatgtattctttctgctcgtccgtctgctcggttgtttgcagcaactggagcatgcccaggacgccattcagcggcgtccggacttcatggctcatattggccaggaactcggactttgcccgcgtggcactctcagcggcctccttggcgtccaaaagcgcctgggcggcttttaccgagtccgtgatgtcgcggaactccacggcgcggaccattttccccttgtacgggagattgcgcgcctccagccgcatgggaaactcttccccgttttttcggcggccatattcctcatagggtttttcataccccgcccgaatatgggccatgacgacatcgcgcgaccgttccgccacaaggaacaggccatccatgccgatcagctcatcacgggcatagccgaacatttcgctcagccccaggttgcactccaggatgacccccttgtcatgaatggcaatgccgccaaaggaagcattatgtaacgccttgaagcgctcctcgctctcccgcagcgcctcttcagccattttgcgggcggtgatttcacgggcaatgcccaaaacgccgatcaaccggccgtgggcatcgtacatcggggatttgatggtctcaaacaggccgctgtaatcgtcttcgacaaaggtcagccactcttcgttaatcctggggccgcccgcctcaatggccttgcggtcattgtctctaaaaaaatcggccagttccttgttaaagaaggcgtaatcatcctttccgattatggccgactcatcagctccgaagaaacgctcaaactttttattgcattgcaaataccgcccatcaatatccttgagccaaacaaggtccggaatggtatttatgatagtccgcagcaatagttccgattgcgccaaggcattttgagcttcctttcgcaaggtaatatcagtgaacatggcaaaagagccattaaattcattgcgatctccttttaaggctttggcggaaaccatcgtccacagttcttttccatctcttcggcgaaaacgacgttcataaacatcatcttcaccaccatgtcttcgggccatgcgttggctgtgaagttccatatcctcaggaaaaaagtaatcctcgactttttggcctatcatttcatctggactataaccaatcatgtccgccatcgccgcgttgacataggtcgtcacatgctctcggtccatggcccagattccctcgttggccgtatcaaccaacagccggtatcgctccatgctctcgatcaattgccggcctgtgcgttcgcgctggagataattgaccaacaacgagcctaataacgcggtcccgacaggatagatggcaatgaccggcaacgcgatattgtccaacaccttcaaggcgatatcccagggaagggtcagcatcagcgccagcatgacaatattaacgaccagaccgaacagatacagctcgcgccaggtcatctgatgcagttggcgtcccctgtaacatcgccaaaccgaaccgataaggcctgaagccgctatgacgccaacgcccgtccatgcccccagtccgccctggaccaaccgcaaggcggaagtcatgatcacagcgatcgccgtggacaacgggccgaagaacaggcctgagatccccaccaggacagaacgcgtgtcaaaaaccaccccaggcatcagcttccacggcgtcagcatgacgaccacgccaatgcccccgagcgcaatgcccgtgaccacctgggtcaggaacgtattgctttttttgaagcggacgacagccacttcaaagagcagcgcgaccgccaacaagagagaaacattctgaaacaggcctatgaatgaactgtgttccatgcgaagcccatttttagtaacatgctaacgaagaagcgcagcacacaacacagaaaaaccagaatgagcctcatcaccacgacgcaccgaagtattcagcaattgatacaatataccatattttcaataagtttacagctatcgttcagaaaagcgccctgagtgtaatggcgttttcacgaccttcctaccttcttcgttttttttcagcaatcactcaacagctctcgtcaagcaaggctttgatttgcctttcaatttcaaacaatagagagtatactcgatttttttcaaccttactctctttcactacgctgaggcaggtccaatctgagaactctattattactccacaccccgccgcaggatttttgcatgcttcaggatcgcagccagggacttcgggaccagatagggcgttgcgcgctctggcaaaagaccgggtttcaggtaccccgaaaacagccgcataaattcgggacgggcaacacgacatcacacggctggctcgacacactgacacgctcggcgcgcagatacagggacatctggcgggcaggctcgcaaccttggggggcgcggggggcagaacagagggggcagcaaaaacagatggcgggacagcagcgggacaaaatgaagacttgaaacaatctgcggggagagggacgagaagaatagctttataaaacaggatggtgcgagagagggggttcgaacccctatgccttgcggcgccagatcctaagtccggaaaaatgcatttccagttgaaccactgtgaactgcaaactgccgttttcaatggagaataaccctgctctcgcgtcagctctggcaagtggacttcggccaaaacttggggcagttttggggcagaaaaaccatgccgcaacaagatggccaaaaaactgtcgagcaactatcccggcgtccgattccgggaacatgagacccggaaggacaaccgccggcctgaccgctacttttccatccgctaccgctgccgcggcaaaaacatggaggaaggcatcggctgggcctccgaaggctggaccgccgaagacgccagccgcatccttggcgagatccgccagaacatcaggcgcggcaccggcccgcaatccctccgggacatggcccgggccgcccggggcgaggccgacgccgccgaagccgcacccctcaccttcggggagctggcccgacgctacctcgactgggccaagcgtaacaaatcctcgtggaaagaggatgaatatcttctggccaaacgcgtcctgccccttttcgcccaccgccccgccacatcgctgacccgtaccgacaccgaacaattccgagacgccctgctggacgccggcgggctttcgcccatgaccatcaaacaccatcttgtcgtcatccgccgcgtctacaactgggcagcgtccacgcccgttgccgacgatccgggacacatgcttttcgaaggccgaaaccccgtgtccggcatccgcatgcccctcgtcgacaacgagcgcatccgcttcctgacccgcgaagaggctgaccgactcctggaggccgccggggagcgcctgcccgagatgcacgacatcatcctcctggccctgctcaccggcatgcgccggcaggagatccttgggctgatgtggcaggacgtcgacctcgtcaaccgcatcatctccattccggcccgcctgacccgggccaaacgaagccgcaaggccttcctggacgaggaaacggccgccatgctgcaagcgcgccgcgaacatgcgcaatccccttttgtttttccaggcgccgtcgacggccgccgggaccctgaccacgtcacccggcagttcgacgccctggtcaacggcatcggcctcaacaacggcgtcacagacccgaagcataaggtcgtgttccataccctgcgccacaccttcgccagctggctggcccaggccggggcggacatccatcacctgatggagctgaccggccacaagtcgatttccacgatgcagcgctacgcccaccttatgcccgggaaaacccgcgcgatcgcttccctggtttcgcgtcgcgcttcgccagctccaaaaggcgttcctcccgggtcttccgaatcgtgaccgtccaccgggtcagcagccactccaccagatcctcccggtaataggccacgctgtcgccgacgctcatggcgtttttcggcccctcgcggcgggtgtcatagttggccatggattcggccgagacgagtccgccaaggaaggtgcccacatgcttgcgggcaatgacgggcggcagttcggccagcaggcgcttgcgcatttcaacggcttcgggcgtcaactcagccatgggaaacctcctcgcggttttcttcttcgggtatttgttcgcttctggccggattggccggggcggccggggtggtcgacacccggtcttccgcgccgacgatgaccacccgcagccccgtgcccaggcgggcttccagggcttgcttcagttccgtcacggtcggttccggcggcggcggcgcaaaggccggctcctgcaccggccccttccggtccggatcgcccgtcagatagacaggcccggccccggtccgaatccaggtcggattgaggccgaatttctcgtagagcaccaccagccaggcatcgggaatcgctccgcgccgcttggcgtcggatatgctcgattgccttatgtccaggcacagggccagggccacctgggtatgcaggttcgttgtttcgcgtatccgctccatcgcctcatcgaacatggccgctcctttggttgggggttcccggccccggcccggccgcgcctgcacctgcgcggccgggccctggaccggcggaaacggggctgacgaaaccggtccgctcacggggcattccccgcccgttcccgattctcggcggcggacagtcggcgtccggctggcataaaggagggccaccgcgcccttcccgccggcttggcatgtccctgccaccgtgcgcctttgattccccgcccccaggccggacgccaggggaggtccggcctggaaagcccctttcgggttccaggtggggagagcctggaggcggggaatcaaagggcctgccccgggcgggcgggccgtcccgccgcgcccggactcaccgctattgcccgccggtttccctggccccggccacgtagggctcaaaacgcaggggatcgtacacgtcggtccggaaatggccgtccaggaaacggccgatgagcagcgtttcctgcgacgcatcacccgacgccggcacggcatcggtatccaggaccacgccaaagggactgccggcctccatatcccgccccaaggccttgggcacgaccaattgcccgggcataaaaatgttgggccttgcgtagtccgcataggctgccagcagccgcgcggcttcctcctcgggtgaaagcgccggattcgggacttcgcgccggtcggccatggcctgtatgaggctcatggggattgacgccagcccgacggacaggcttcccggctctttcccgtccttcccgggcctgccgccttccgcccccctctgccgggcctcctcccgaccgtccgtttcctgttccgccctgccggccgccccatccacgttggtttgcagatcgtccattgctgtctcctgtcggtcagtatgtgcagccacaatcggcctaccacccttccccatcatcgccgggccgatggtccagcccgcccgcagccgccagccagaccatggccgccggccacgccagcgccagcagaagcctccagcccatgttccgccccctcctgcttgcagcgcagcagcgcccggcaatcgccggctgcggtctccaactgctccaccagttcggccagcggctgcggctccagcacaaacccggggcgcaggctgcggccgtagcggcggtaatccgccagcagccggaacatgaggtcatagacaatggccgccgctgcttcctcgcgttcaatcatcgccagcatcgcgccaccccctggcccgtatgagccattcgatcgcaaaacaggccgctccggccaggaaccacgcggctatggccgccactgcccaatccttcattccctgtccccttccggcaggctgcgttcgatgccgaaatactgccgtggttcgggttcttccggcaggatcagccggtcctgtacatggcgcaccgcaccaagcgcccctttcacggcccgctggttgatgcctgaaaggtccgggtggtccaggcacaactccatcttggcgatggccacggccaaccggccgatgagttcagggtccgccggcatagctcactccgtgaacatgtccgcccggtccagcagcgtccgggccgccggctcccgttcctgggggaccaacccatgttcgagcaggtcacgcacgagcctggccagctcccggaccagggtccggcaccgcagcgtctgggcttcggccgcagccagggcttctttgcggacgtcaggcatcagccgccctgccgtcgtttagcgcctcgccctcgaccaaaagccgcccggccagctcccgcagctccagccgcaggcacacgccttcgcgaagcagatagcccatggcccccatgatccgccgggtctcggccagctcggcccgggagaggcgtcgcatttcctggtacgtttccagctccttgcgcagctgcccaagggagcgcgcgtacgcctcccgctccccggcccagtcccacgagccggcgagccacgaccaaagcctgcgccaccagggcatccgggaaggttccgccgccgccatggcggcgtccgtcccgcccaagggggagcggtcaaaacgcagatgtttgggcgccacgggaaaggagccccgggcctcacgcgctgccgcagccagggtcgccacggccagaagcgccgcttcggaaacctgccggccctgggacggcgaaagcgtgccgcccatgtcgcgcaacagctccagggcgttgccggcctggaccagaccgcgtagaagcagccccgtcgccacgccggccttcccgctccacggctgcggcgggtcgtctcgcaggcaccgctcgtattgcgccaccagccattcgatgagcagcggcgtgcctagggcttggcagaaacggggcaccagcggcagcgggatgaacttgtccaccgccgcctcgccaaaccagcagcccacggtctggcggttgcggtccatggccgtggcaatggcgtccaggtccaggccggacatgcggcgcatcacctggatcacctgcaaacacgtcgcgtcttcaagggcttggccggggttcatgaaacaatcctcccgaagtattcgcggtttccgcttgccaggacggctaggtacggcccatgggccacggttccgcgcccacgctgtcgcgcaccattgcccggccgtcctgtgcggccgtccgacgtctggcgcggttcagctttggcggatgcgcgaccggcgtttaggcccgggtttcccgggttcgcgcggttcgggcagcagctcggccggcacgcccagggcgatcaggtttcggatatggtcaggagtggcccgccggccggcgatgatgttggagagcgtggttttggacatgccggcgtcggcggcgagatccttgaagacgatgcgtcgttcgatgagccaggcgcggcagcgatcttgacgcgtaggggtaattgtgtgaacaggttcacagtattgcatcgtgaaacctctttcggtccgctgtcaggacgggcaaagtcctggttggcgaaaatgtatccctggttcccggactaatgaaaaacgaggacgcctgtcaacgtttttcaagggcaaaagatgaatttcgacgacaaaaatgactttgctcaacgattacgccacttaatccagtgccttaagataaaggacactgaattcgctcaacagggtggcgtaacgaagcaaacactcagcggatatttaacgggaaaaagagaacccggccggagtaccctggcgaactgggtaaacgcttttcacgtcaacggaacgtggctgctaactggcgaagggggaatgttttccgaggactgtaatcagaaaacaaacgactttcctcaggaagagatatcggataagctcacatgtgagcagcgcaacatgctcacctacaaacgtcttcaaaccgagctaggcatggacaagcagcgcatcgccgaaggcctcgaagccatcgtgatgggcaagcggcccagctcacgtaagcccgcaaaggagtacggatccggcgaggacgttggttacagtgagaggggtggggatgagttgtttgggggttagggaaggaagataatttcgcagaatgccaatcaggactttcgtaatgggtcgccaaatctcgaaagaatcatgcgccgaagcggttataaagggtataaagaaagcccaacgaaactacgaacaatggtcaggcggtgattgggtttggactgctgcggaatacatgttgactgtatatgtcgccaaagaaatttatgctattgatggcactaaatatgttacgattgaacacaacgtccttcaggcaattaatgatgcaggtgcgatagctcctggcccaaagccaaaaaatgctcgcgtccggggacgttttgacattttgctctggtgggcaagtgaatatcctagagctgtagttgaaattaaaaaccagccttacggatcagacgtttgcacaaaagatttcaatagaattgacgaagtgcttagaatccgcaaggaagaaagcagccttgaatttggaatgttcggattttacacatctgccataggcaattgtgaaaaatctgcaacagacaaagtcgtcaacaaaattagaaacatcaaacaattggcgattgacactatagggcgcaattgtaaaattaaattatttcattcaaagatatacacggacaaacacgagagcgcttgggcagccggatgtctattgattgaacgtagataaagaaatttttacgcaagcaccatgcaaagctactcaatcacaaacaccttcaaagcgaactaggcatggacaaacagcgcatcgccgaaggcctcagagccagcgtgatgtgtaagcggcccagctcacgtaggctcgcaaaggagtccgaattcggcgaggacattggttacagtgatgccaaaaaattacaaattttgactaacaaaggacaggcaaatgagcacgtactcagacataatgttacaacttgtaaattctattgacaaaataacatcagtatcaacgtatattgtttttctattactactgattgccggcataaaaagcggtgtattcaaaacaaaaaacactaagaattttgatattgaatccaaaaacgacagcgaagcgaatgcgacagcacaacaaaaactagacagcactgcagacgacacgaataaacacagaacatacgaagaaagtaaacttttagaatactacacccaggcgctcaaccaatcaaaaacaagcttttggttcagcttaatatttgcgtcattagggttttgcataattgccagctctccatttctatacaaagaaggaggaggacttgacgccacagtaaaacttttatcaggaaccatagttagctctgtatcctccctattcttcatccaatcaaaacgcgctcaacaagccatggtaaccttttttgataaacttcgctctgaccgcttagcattggaagctaaaaatatttcaaacgagatacaaaatccagatttaaaagataaattaaaaacaattcttgtcttaaacaatgcaggacttgacacttcatcattgctttcagattgcaaactctaaccgacactaaacaacgacaccaaaatcatacacaaacacatactaaaaatagcattctagcaacgtcaacccagcaaaactacatgcaatgccacgaataccacttgacatccgcccctgatatgcaaacaacaaaggaatatctacaaacttttcacacctaaaaaccgtgcttcaaacccaaaacatatcactatccgataaatcaaaactcaaaaagatcaaataagaacacaatgagcactgccgtattcacaaaaaatcgtagtattttttggctaagaataaacgaaaacgacgacggaagttatgctttttttgtatcagatgccgcccaaagagtactcaactaccactttccaatccttttccagataagcccaactggatggaaagatggaaagtctaatgtcaaatacatctggatcccaaaagacagaacatggaacatagacattgaatcaataaaaaaatgggctgattttgccgtcaatcattgcgtctggattgattgtgccaacgaaattgaatactgcgtcgcctgtgatttcaattttgaagttattaacaacgaattcaagcgcacaccattgggattggcagaatttaaaataaagtatcgaattgacaacatcccagaaactgaaaaagctactcatctaaatctgatgtacaacaaaatgtgttgtgcttttgatctattgccattacgatacaagccaagcaggatgctcttcggaaagaccacgccacccataattacatccataccagcaaatacaggaaaaggaaaacttgcgtggaacctcgcaaaatatatagctcgccaaaaaagttttgacttggtagaagctcagctattgccacccaagccagaaatgaaaaacctgcgcttacaagaaaaaataacaacttggctaaatttatatcagattccaatgtccgttagcttcaatggagacatgcgagatcgagaaattgttatagttgatgacctataccaatccggtgccactatgcaagcatatgcaaaacatctaaaatctttaggagtacgtgacatttatggtttagcgtgcgtcaagtcaatgagagacagtgacaaccaatgatatcttctattcttcaattcttacaagcaaaaggatccggcgaagcgctgcttcgtcgttttctgctttttgctgcgataaatggaaaaaatgcagcaaagagcttatgcacatctatcaacaacctctccaatgaactcaaaataaataatgacgttgcatcaaatattgtaaattcagcaagtgaagcattttttttacatgaaagcctttacaaagacaacataaatgttgcttggataggctcagatgtctacccacaccacctcgtagcaacattaaaatacgatgctcctcctgtattgttttttaaaggatgtaataagttatttgacaatatgggagttggattttgcgggtcaagaaaagcgtcagaaaaaggacttttaataactaggcgttgtgttgaattactagttgacaagaaaatttgcgtaacaagcggatacgcacacggcgttgacatggctgcacataaaactgcgttaaaaaacggtggaaagacaatatttgttcttgtggaaggaataatgcggttccagcacaaacgggagattgcagaatttctttcagatgacaattatttagccgtctcacagtttccacctaatttaacttggtctgctcgtaatgccatgaaacgcaatgggacaataattggtctttctgatgctatgattcttgtagaatctggcattacaggtggtacttttgctgcaggcaaagaaactctacagcgaggccaaccgctttttgttatcgactatgctgcacctggaccatccgcagaagcgaaccccaattttataaaaaacggaggcatccctatccgaggaaattctgatggcataccaaatcttgaaaagatatttgacattaccaaccaaagcagacgtaacgatataaatacaaaagacctttttacaaagcatcaatcaattaaataccttcaaaaacatgaaattttactcaaatccagaaacaaattaatcacgcgagacacataacaaaggattgtattttatgatatttccaaatgatccgatcttgattgatgagttcataaagcaaggaatcagcagagacgactcacataaattgtttaactctggatactatattgcagcagacggtcatatagctgattctttttatggcaacaaatactattctggacttcatcctcttaattctagtggtgttaaattttctccaaaagaatttacagtttcatcattatcagaaataaaatcaatattgtcggagccagagcacgccgtgtaccgcagtcgtatggtttttcgaggccagacaaaagagtactacactcagcgcgagtatccaaatcctattgctgagcataaaggcaaagaaagactcatcataccaggatattggcgtaagttttcaaccaattggaatttgcgtttttctgcacctgactacgagtctgtatttttatcaaactatggcgacgaacttatatatcatggaattgcgaactggcgaaacttggcatcaatcaattcgagtcgctacggcccacatttactttcggatcttgaaaactttcccgatcctgaaagtcaagaatatggtagacgatggcaagcttttaaaattcaaggtatagcaaacacatcacttccacttgttgaacaacactacggcatagaaacaactggtttagacgttacgtttgacgtatcaatagcaacttttttttctttacatcagtttacaaaaaggcacgacgacacagcttattatcaacctatagatccacttttacacgctggaatagtatattgtatagttttcgaatctccacctctaacaagagctacgcaaaactatttaaataatgaaattttttctcatataaagcctacgagaccagtctcgcaggactgcgctctcccatttttcggacgccacaacattaacgaggccgttgcagatttactttgtatttttaaaattgctccaaacttcagcacagatgatataccaaattcaaacgatcttttccctgaaatatataaagaccctttttacaaagcagcgctcgaagctaaatttaaagctatgaaatctagtcccttaaaaaatatcgtcgagtattctttgtgaattacaaaataacttaggtccaatatggatataaacataaaacacggattgcccggccgaggctcccgagttcatcccaatgttgaagccggtgttgctggggtcatcctcggccagccggctcctgaggatacgcggcaggctgtccacgtcattacacttcgcctgggtcatggcgaacccgtccgtcgcgtggcgcttggtgatgaccagatggtggccgggcgacacaggaaatccatccggaatggcaaagacggaatcaaactcctcgacaatctggctcctggccacctatcaaacgagtcagtcatcgaacacgtcagctcggtcaggatgtcactgttgtcttccgtcttgcccgatgcaatctgatcgctgagaatcaatcagccaagactaaccgactgtgtcatcggaggatttggatgtatccagttacaagtgaaaatcacattagacggttataaaactcgttttttaaatatactaacactgaactaataaattaagaaaggaacaattatgaatcttgggcatcttgagcgagttgatcttcgcaatatatgggagacagaggctcaacatttcactccttggcttgcccaagaagataacttggcaattctatcggaagctctcaatattgaattagaacttgaagcacaagaacaaaacgttggtccatttagagcagatcttttatgtaaaaacacagaagacagctcttgggtgttaatcgaaaatcaaatggaaatcacggaccacaggcaccttgggcaattgctcacatatgcctcaggtctccaggccgctactattgtttggatttctgccaaatttacagatgaacatagagcggccttggattggttaaacaatataaccgaagaaaatttccgtttttttggcttggaagtagagctttggaaaatagggacttccgcagctgctccaaaattcaacattgtatcaaaacctaatgactggtctaagacagtatcaaacggaaaaaaaagcatagacaacaaatcaacatctgagatcaaacaaaagcaatacagcttttgggaattacttaaaaatcaatttgataatttaagatgtggcattcggatcacaaaagcactacctcaacattggatcaatattagcattggaaaaactggatttaaaatctgcccaacacttaacactagagaaagcaggctcggcgttgaactatacatatcatgccagaattctaaagaactatttcaacaactatacagccaaagagactctattgagcgtgaatacggcgaagcattggactggcaagagctgccagacaaaaaggcttgcagagttttatttaccaagactaaagtaaatcctttattagaatcgttgtggcccgagtacatcaattggtttgaattgaacataaagaaattttacagctgcttttataataggataaaaacacttagtgcttcaccacagctagaagatgacgagccaagtcaatcgtaagcaagttttaacatacttctgcaaaatcaatttataaacaaatatctaaattcaataccccattttgcaagggatcacccctctcaccccaccgcgcggattttccgtatcgccatccctcctcggaatgagatggatatggacatgaaacacggtttgcccggctgaggctcccgagttcatgccgatgttgaagccggttatgctgcggtcatcctcggccagccggctcctgaggatccgcaacagactgtcagcgtcgttgcgctcagcctgggtcatggcgaaccagtccgccgcgtggcgcttggtgatgaccagatggtggccgggtgaaacaggaaatccgtccggcatggcaaagacggaatcaaattcctcgacaatctggctcctggccgcatcgtaacagaacggacagcccggaatcgcttcgccctgggccagggcccgatagtccgtatcctctttgttccccttggaccggttgcacttggagcagagcacctgcaggttggcgtactcgttgccgccgcccttggaacgcggccggatgtggtccacatccagcggccgctcctggttcgtggccccgcacagcgcgcaccgcccacccgactccgccagcacccggttgcgcaggctcccgggcacaggatcggtctccagcatccgatagtcccagatccccagcccgcgcttaagaatgtactcctgcagcttccggtcgcagatcatcctgatctgcgccttctgctcaaaggacaactttcccgtggtcagctccaccagattgccgctcgaagccaccaccccacgccgctgcaacaccttgagcggcatttccttgatcttccgctcataatacacaatctggctttcatcctgatccagaaaggccatcgccagttgccggacggtggccgatcccccagcgtccaccagcgaacgaatgagcagcggctggtatatgtgctgcatggccatccggtgcttcaaaaactccaccagctcctgaaaatccatggatccgcctgtaagttgatttcgtatctcgtgttacccaggccatcttaccgccaagttacagatgaaacgtcaaaatgcgtttccccgcaacgacggtttttgcaatcccatcctgggaaagcgcgtcgtaaaagaaggtgaaccacctagtctagcggttcaccttcaaacatcttcaattatattatttaaataagattcaaatcgaaatggaactccactagaatcgacttaatccttccattgctctgaaatggcgtatatcttctccttaagtgaaataaaaacatccacaatttgaggatcaaactgtgttccactgccttgaacaattattgactcagcctctctcacaggcatagcttttttatacgatcggtcactgcacaaagcatcaaaaacatcaacgagcgacacaatgcgggcttctaaaggaatattttcaccggaaagaccaaaggggtaacccgttccatcccatcgttcatgatgaaacaaagcaagaattctagccatccgtagcaattcataatcattatacccaaggactgcttgaggattggcacatagatctcgagcgccttcacgatcatctaaagaacctaatatttcgcagccgtaagtacaatgccttctcattatatcccattcttgctctgtcaaacgacctggcttaagtaaaatttcgtctggaatgccgattttgccaaggtcatggagtgatgcgcactcagcaagtatattacaatgatcctcttccatgcccatagcttgcccgataacgcgactgatttgagccactcgaaaaacatgctttcctgtctcattatctttgaattcagcagctctactcaaacgcatcataacttgatgcctagtttcctcaacctcagctgttctctccctaaccaatcgttcaagattttgctgataaatacgattttctcgcaccaagcgtgcacgctcaatgacattttttaaaacatgatcaaacacatccatgttatgcaacggcttggtaatgaaatcccaagctccaagccgcacagcagaaagagcgtcttctacaataccgacaccagaaagcaccactataggtatttctttatcaaactctacagcgtgcgcaataaatgaataaccatccataactggcatattaagatctacgacaactgcttctatttcgccgtgatgctgcttaagcaattcccaaccttccaaaccattggcagcctcgtagacgtcatagtcaacatcttctaaatgagcaaacaacgaacgacgcaaaccatcctcatcatcaataatcaatatagccatatcaactctcggattgttgtcttagttgacgaatacgatgcaagatttcatgaagatcacaaggctttataaaagcatcatcggaagtgagtccgatctctgcaagagtttcaggatcaagaagatcaatagacccagtatgaagcaaataatgctcgcaataccccatctctccagcaatacgaataaattcattgccattaatgccgggcaaacgcatatcaacaagacatatgtctgcctgttcttctcgtaatcgttcaagggcttcttcagccgtggctgcagttctgacttctagttcgtcttcataatcttcaaaaaaaagcaaaagattatgtcgaatacgctcttcatcttcgacaataaaaagacgctgtcgatgctggctcataaaggcttctctaaggcttgatcagtgggcaactcaataaaaaaaacagctccttcaccaatgacggactgaactcccatccgccctccatgtcccttggtgacaataaaatacgaaactgacaaaccaagcccagtaccaactcctggtgcttttgtcgtgtagaatggctcaaatattctgcgctggatttcgggaggtaccccaggtccgttatcctctatttccacccgaaccatatcggcctcggaaatcatacgcacaatgatctttggcgaagccacaggcggatcagccgaagccaaagcctgagctgcattccgtaaaatattaagaataacctgttcaatttctgtttctgtacaatgtatgggctgaacgatctccggaaaatcgcgttcgatagaaattcttttaaaatcataattttttttcaaatcataatcactagcagccaacacaactgcacgttcaataatagccgaaagatcacaaacagctcgtttagattcactcttccgactaaaatcaagcatgtgccttataatagcggacgctcgaacagccgcgtctttaatatcgtgaacaaaaacgtccacttgacgtgcctctatataacgaacaacatcctcaagattgacgcttattttatgtgcaacatcatgattcttcttaaaatcaagacgaatacgctgtacaatattttgtgcagcttgcaagacaatcccaagagggttattgatctcatgagcaatgccggcagcaatcccgccaattgaaatcattttttctgtttgaatcatcatctcatgcgctttgtgcaattcagtaatatcccgaagcacagacatacgatagcgcacagcgccagtatccactgtctgacacgacatggagaatactaactctcttccctcagcgacctggacaacaacctcgacattggaaactgattcctcctgagacatcagagacaccgtttcactttgaccattcaagaacaatccaacatccatgaaatttcgaccaactattctttctctattggtattaaataactccaaaaaacgttcatttacatctagaactttatttgttccgagatcagtgagcataatgctatcaggcgacaacaaaaaaagacttgaaaaccggctttctgagtctctcaaattttttaaaacctttctgagagcattaagagacacagcaacaacaacaagtatcaaaatagaaacaccaacattcacggctgcaagatgatttacaggagcaactatctctgctttttcagcttcaacaaccaatagccagccagtaattgcatttcgcttagtcaagctaattcgttgtacaccatcacgaacataattcacgatttcatttgactcagctgagttgacaataaattttgtttcttctccaacactaaaggcatttccagaactccaggatggacgtgcaagcaccacaccattttcatcaataataaacccgcctccatgaattccaattcgaactttagacagaagactccgagcaaacgtttcagtatcacgtataataacgagcacaccatccacagtattggctgatgatttgatcggaaatgaagccacaagaatcggagacccgctcactcttgatacagctattgtttctattgtgggctctcctgcacgagcttgcaaataatagcggcggtcagagacatcaagtttgccagccaaagactggtcagaagccaaaacaatttgaccattagtattcatcaaatagtagcgttgaaacacatcatctttaatatactcttctaatttgcgagtcgcagcttctcgagccgagctgcccaagtagctcgactctaaaccaaacaacaacactttttcacgactaagaaagcgcgcctgagctagcacatctctcacttcaacagtaatttcatgatcaagcaatgaaagactttgcttgatctgagcattagccaaatcttctacaacatgcttagtataaacgtatgctaagactgtacttaaacacgcaccaacaaaaacagtcaacagaatcggaagtagcggacgatcaagcgcagcattgaattgaacgcgacgggttaatcttttcactgaattaccacttcgcttgcttcaatgaattcatagggtaaattaataccaagacgagcggctgtcttgagatttaaaaacacgatgccccgttgattaagctggatcggtagggaggctggagctatcttatctacaagtacctgatatgcaagctttcccgcaagaaacccttgctcatgtccagactcgagcacacctgccaaatgaccatgatcctttgaaaagtctgtaaagcctaaggtaggcttggtcacattggagttgttccagtcactgaccaattcaggaggaacaactttattcgtattctcatcttttagcgaatgataaagaccaagagctaacacatcaacgcgatcatgataatgccgcactaaactttgccactgttgaaaagtactagcctgctctacgccaagaacttccaaaggaaaaacgcccccaacttctctttctctctgcagatcagctaggacatagcctgctgattcggaactatcgacaagcactgctacagacttgacccagggcaaaaactttgccatcaacgcaaaaccttcacgaaaatgccatctttcttgaactcctgttacattcacagatggataaccgtattgagacagaggggcattgactccgcaaaaaacgacctttggaccatctttatctttcaaatatggaacaacaagatatacctgagctggatcgtcaacagcaacaactaactgcacattgttttgaacaatcttgtcaaaaatctcaagacttcgttttcgcaaaaactccggggatgggttatttttagcatctaaataataaatatcgtacgacacctcaactcctcgcaaagcttctaaaattccctcagttatattttttgtccaaacatattcctctccatagctatgaacaatggcaatacgataaggaccagcagcaactccgtgcgcaacgcccaatccacttaaacaactgacgacaaaacaaaacaatattataaaagacttcaacagcgagaacatacatacctccactcacgaccagcgaggcgttcaactacattactgatgaaaaattcagccaacaaaatacagacaaaatattcattttaatattaactaagcccagggtcacgccaaatagaaaatctattcttacctttatgctttgaatcatacaacgctgaatcagcctttgacagcacttcttcaatattattattacgaccaaagactacacacccaatactaactgtaatttttattttttctttttgagtgtcaaacaaattttcattaaattccacaatcaatctatttagaaatggcgcaacatcttccttaccaacaccaggagccacaacaccgaattcttcaccaccaactcgaccaagtacatcaacttggcgcaatgaatttttcagtatatgagcaacatatattaaagcctgatctccaactggatgcccataggtgtcattaattgctttaaaattatctatatcgatcgacaataaggcattcgaaacatcaaatctcgcagatcgttgtaattcgccatgcaatgactccataaattttcttctattatatacacctgtaagttgatcagttgacgacaaaatatctaacttttcttctgacattttaagctcagtactatcactagaaaacactactacccctttttgaatattccctttgacttctgaatacggggtataaactacagacatatagcgccgacctatccctggaaaatcaaaccacgcctcatactttgcttctacaccacttaacgccttgtcaatattaggctttacaaagtcacaatatacattttcttcaaaaaactctcttacttcatgtccgacaatatcaatttcattttttccaaacactttgcaataatattcattaacaagaacatatcgacagctactatctacaagagaaaacaacgcaggcgcatttgcaataatttttttatacctagacaaattcacccttgccacttcttttgtataaactaaacctattgttgttttgaactgaaaaatactatatggctttataataacaccggcaggattaatactgagcattttattaatagtatgttcatcggaagcccctgtgactaatacaaccggtataagcaactcgttttgaattatttcgcaagcatcatatccattcatacctggcatataaacatcaagcaccacaatatcaggacgaagctttcttgataattcaatagctccgataccgtcatttgattctccaactaaatcatatcccaatgcttctgaaaaatctttcaatatacgcatgcaaagcttcgaatcatcggctataacaattctaggattcattattaacctctgttgtcttattgattacaggcaaaaatttgtaatattttccaacacttgctattgttgtgacatttacacggcttaaatatatacaattctttacagatgtcggtttgaactaaaaagtgtctaaattttgaaataagaaatattaaataacttacaaataaatttgtatattgcgatactttattataggctttatgcaacaacattatatcggtttcgaacttcagtcactatattttaacacttggatcaaaacaacttttcgcaaaacattattcatctaagcacattcaatatcaaaaattttataaatcgccaagctatcgatacatattgcaatgtctccaacttttacatacttgactcctaatgtacagtctgttgtacaaactcacagggcaatcccaatctcaacagctggtatttacgataatcgggaattcgctccgtacaactcaccagccacttccccggcgcacttttgtggacgcccagctttcgtgccagatccgtcaacgtcagcccttcgctgcgcagccagagcttgaggcgctgctcgcgggggagcatcgaccagtctgtcggcagggccaaaccacggggacggctcatggcagcacgaaccggccggcccgccacaacacccggcccacgcccaccagttgctggacggtacggggccgctcgccaggtgggacatcgagctgcagcttgagcaacgcctcaaaatgggcggcatatgcatagcagcgcttgcggatgtccaaacgcaccgaccgctcaaagcgcaaccggatgcacccgtcctccagggcaacttccgcacccttggaacgcagcaccgccaacgggtcggtcaaccccttgcggcctgatccgtaagccaccttagacgtcagcacgtcagcccctggctccatcctggccttcattctgggaacagccaaccgctccacatggagcaacgcaagattcatgtaccctccccggtgtggcaagccacctgcaggccagaccgggtaacgcacagccgatgccaaacgccttcatcaaatggtccgcattgtcttttcctgtagcacgcaacgtcaggaagcagccaccccattttagcgccagtcgcaggttggcgacgctctcgatgcctgccctgctcctggccggtatgcccgttttacggctccctcgccccaaacagggttttataggcttcagccgcccggtccatggcccgcttctcccggccccgcaacatcagcagccgggtcgctttgtcctcgggcggcaactgcgacgtgcgcagctccgccatgtccgcacgcacagcctgcacctggcccaccaacaggcgcaggcgcggcagccgcgtctcgtggcgcaaccgggccgcgccctggaaatccccggcctcgcgcagggcatcctgccgcgccttagcctcggcatacgcccggcgcaccgcctgatacggatggcccacgtcctcgaaatcgccaacatccagggtttccgccgccatcggtccggcctggccgccaaggcgcgcccgttcgcgcttggtcggccgctccaggcggtctgcctggcgcagcagcgattcccgggtgatgggcgcgacgcggccgccgagcacggccgcgtcggcgttgaaggtgttaatagccgcaagcagggcatcgcgctcgtcggcgtccgtgccaccgtccagggcaaaggcccggaaacgcgcgtacagggcgtcgcgttttgccgcgtacccgctttcctcagcaatggcctcggacgccttggccctggcccgggcttcgcgcaggggccggaatccggccgccttggctgctgcctccccgagggtcggccgcagcggcttgccgccttcttccaggaccggataattgctgcccgtggtcacgccctggcggtattcacggatgccctgaaggatcttggccgcgcccgatggcagggccttttccgccgcccggccgggctggcccccagccagatagcccattgcctgaagcaggtccttgcccaggccgccgacagggccaagcacatccacccaggaatccggcgcatcgatcatggtcatggacccggacagatccgcgccggccagcaggcccaacaacccaaaccgagccagatcctcggccccgccgcccaggttcctgctgatgacggcgtacagccacttctccggatcctcgtcgccgccgaccgccgtcaacaagcccttggccagggccattgccacatgcccgccaaggccggccagcgccgccggcgcggccagggcaaacaccccggcggcatggtcctttttcccgaacagttcgtggatgagctgcaggtagttatggccgtattttttgtagatgtaccagccctgccccagccgcgccccgagcttcgtgccccaagcccaggacggctggctagcccggtcgtaaacgccgtgggcccggtcggaggtctcgcgcgcccgcgctatggccgtggcgtggtccgttccggcggcccgggccagccggtagccggccagaagggtcgcgccccggttgaggcgttcggtcgctccgaacaggagcaaagccttgcccatggcccaggtccaggcctggccggccgtgtcgcggtaaacggacaacgcttcgcgggcgaactgcgggtcgtccagggactcgcggcgcgcctgggccatgaaggcgcgctccccggcggtcaggcggccgctccggccggccatgaggcccagatagtcgcccatggcccggacgatctcccggccgatgcgcgcccagccgcccttgccggccatggcataggcatgcagcgccgccggcacgctggtcgccatgctggtcaggttgaccagggcgcttttggcgttgaagcccaggtacttcaagctggccatggacttggccagagcgaacacccggtcgccggcttcggcgttgcgcaggttctcggccaaataatccacggccagccggtagacctcgccctccttgcggatgtccaggccctggccgtccgtggcgaacagcgccgtggccgccttctgcgccgcctcggccttggccaggccgtaggccgtggaaccggcgtaacgggaaaaccgctccaccgcgtccttgaaatagccttgcaccacctcgccatgccggccgctgcgccggatggactgggaccggaacccacgcgccttgacctcgtcggccaacgcctccaggatctcgcccacgagcccggcctccacgtcctcgcccacctggttgacggccgtctccacggtcttggccaactccaacgtcttgatgacgccctgggtggcctccggcagcttctccaggcgcgtcaccgtgtccatcgcccatccggcgcgcgccatctccagccgcagtttctcggccgatctgcgccattccttatgggcccggaaccgctcctcactgccgtcggtccctgtccgccgcccgcgcaccacgaaatcccctgcctcgcgcaggcgcggggcgtagaagccgcgcaactggcccatgcgctccaccatttcggcaaagctgaaggtcgtgccgttttcatcggtcaggcgcacgtcggccagccgacccttgatggtgacgccgtctttgcgcgcggccgcgaccacggccttcaccttatcggcgtagggggccagggcgtcggcaagaatcctgtccgcgttgtaggccgccgcgtcaaaagcccttgccgcttcgaccggaatgccggcctcgatcagccggcgcgtgacggcgcgggcatagccggcccgcgccttgtccacgagcctgcgataagcggccagacgggcatcgagaagccggtcataggccgcccgcatggcgcgccataggccgatggtttcggccttggccccatggtcggcaaaccacgtctccatggcttccggcccgatctcgttgacgtcggcgtaatccacgccttcattgagaatatcccgttgctgcggatccttgaggatgcgccgggcctcggaggcgatggtcttgccgtcgcccaggtcaaaggcgtcatgcaggatctcgtgggcgcggtcggtgcggctccggaagatgtcgtacagccggcgcaggaccggatgctgccagtattccggcgagcgcaggattttccccagcacgccggtttccctggtcagctcgcgcacggacggcaggaacgagcggatggtggtcgtggcttcgtccttgagccagggggccagctcgcgcttttcgctcggcgcgccggcaaggtcgccggcccgggaaaagcggggggcgtcgcctgccggcggcaggccttgttcgtacttgacgagatcaacttccgtgaatatttttctcttgtccctggttggcatctctgtgggcaattggagcccgaaagatctctgccaaccggggacttttgttttgtcccgatagagcaacaacccttcccgaatctgccgcgccacccaggacggccctgcgtccttggcgtacacgctggcgacctcgttgatctccgcgcgcccttcccggacattgagatgcaccgccgccaccaggaacgaatcctgatgcggcaactccgtcaccaccaccagactgtccgtccaggtggccgatttcaggacaagcacaggccgttcgagggcttgcggcaactgctgcagcacttccggtgaaaccccgtgcttcccgcctgcatccgcccctttcagtattttattcgcttttgcctgggtcatttgcaggggcagatcatggccccccagcagcccgatcaccggcggcgttccgccaaggtcgaggcgctcgtggggaagaaaccgattgcccagaaaatcatccacctgctgcgcccaggaagccccgtccccgcgcgaaaacgccggcgcggcagccagcggctgccccagcggcgcgatgaaatccagccctttgccgtctacaaagtcgtcggcctgggccagcagctggcgcagttcggcccgggtcaattccagcgtcgggaagatcgaccgcacccagaccgcgattttcgacagcagccggtccagggcgcggtgcaccgtgccgtccttggcccaggccaccaggatttcctcggccgcctcggcccgggtttcccgggtggagtccaggccttggcgcgtaagccagtgcgacacctcccggggcatggcctgggccgccttgcgcatgtactcctcacgttcctgggagccgcccagaacccggtccagtccggcatggcggccttcatggcgcaacagcgtctgcacgaacgccgtctgccctgccttgaccgtggggatattcccggccaccagggcaatgcgtttcgtctcggcgtcatagaccccatggaaccgcccggacagcccggcctcctccaccgcctcgcgcagatccgacggcatatcggcctcggacgggtacacatccacgatgccctgcagggccggaaactgtgaaagcccctgccgcagctcggccgccacggcctgagccacagtcccggcaggaaaaggggaacgtgaaaacagggattgccccttgtcttccggttcgacggaaattatatttgcttctgaagctccctcctgccgggaaataccagaaccggtcggagcgtaggcggcggcgaggttaacccttgcgccgccatcttcattttcccaccccgtcaagagccacacctgccgattgccatgccgatacagcgagagcactgcggtgtggcccgcgtaggcgatgcgtacacgctcgcctgttgttccctctccctgcctggcgacaatttgcccgtgtgcgatgacagccggcattctcctggcgaccgaaacgccgtcagccccctccagattgcgttgctctaccagatgggcaagcccctcgccgcccactaaacgccctttggcattgagttttccaggctctccgtaaataaagacaatgtcgccgagatccggccgggccatgccgaccatttccccagtcttgtcctccagcagcttttcaatcgccgcttcgccgcgcgcctgttccaccagcggatcggctgcggccggtttcctgtccgctaccgtgtcggagcgttggaacatcgccacgccccggcccgtctccttcgtcttgaccgtcgcaaagaagtggtcgaaggccgcgtttatggccttacgttccgcgccttcgggatagggccggatgttgagcagccgaaactccagcatggcgttgttcgcgccgtagaccaggaaatcgctgcggccgccgccctgggccgccttgtcctcgacgtaggcggcaaacgcccgggcggccagctcgtggggttcgctccagtaatccgacgtccggccctgatccatgaggtaggccgcgcgccggtactccgtggggatctgcttggtcttttcggtctggcttctggcgtcttccagcatcttcgcccgtctggcgaagtcctggacattggccgccagcgaattgaacggacctgtcctttcggcgttgaacccgctgcggccgcgcacctccttgtagatcgcggccaggccgtcgaggatgtcgttgctcgaccggtaggagccaaaccggctgcgctgccgtccctgggcttcgttgctgcgcatctccagggccagattgtcgccgcgcaacagctgctcggccaggacgtcaaaacgcgtcaactgctcggccgtggccggcgcgcgcttcctgccccattgggcttcctgggcaaggccggcccggatgtcgttcaggttgcgttccagagtgccccgggcccggctgacgaaccgctcggccttttccgtgtcctcccggtactgctccgccttgtaggcgatgtcagccaggagtttttcataagccgcccgcaacgcctcgcgcacctgggacttgcggcttgccccatggctcaggaaatcctggcccgtggatgagctcgcggcaaagacctggtcgccgcgtttgttttcgaccttctcggacgacgccttcgtgtcctggcgcgcaaggtaatggtccagggcatggaaccattcatgggccagggagccggccccggtcatcttggtgaggttgatgaccccgtaatcccgctcataatgggccttggcgctggaaagcccccggccccgcgcgccgaaggccagggccaggtcgccgttcagggacagcgccctgggcggcacattcaggatctcggccagatccagcaggccgtcataggcgtggttgagcacttcctggcgctcggcctggtcgttccagtccccgaactccacgccgcgaaagccgaacgtatccaggaagtcctggcccttagccggccctttgcgccggagcgcgcctttccggaagactttttccggccgggccaggatctcctcgccaaagccggtcctggtattgaggatgtcctcggcatgttccgccatatagcgcttggcgtcttcctcgctggcgaatccgtccttgatgaccacggtcttgcggtccgtgaccttccggtagatctcccaggcctcgccgcgcctaccgacccggtgcttgagcgacacggccgccaggggaatggctgcttcggcctcctccttggagtcgaacttgaatctcccggtgcgcaacgtgcctttctggtcggcaatggaccaataggttttgtcttcgcccgagcggaagccggtttcactgacctggacagcgacaaatcgtttccgccaggccgggacggtctcgtcattcccgggcagccgcacgcgcggtccggtcggcgtggccgtgtccttgcgcgaaccgccgatcttctcgccaagggtgaggcccaaggtttcgcccgtgtccggagctgccgtctgagggattgctccgggctggcttgctgcggctacctcctgcccctggccggttacgggcgcttgcccggcaacggttccggcctccccggccggcgcagccgccggagcctggacgccctgggacgccgcgccggaggccgggacttccttcggaactgccgtgggcgtttttgcagccccgccgaccacggcatcatacgccgaccgcagctgcggttcttgcgtgtcggctatcgcctccaggaaacccagccgcgacttccggcccggcttgaggccaagggccttgcccagggcgttttgctgctcacgcgaaagcgcctgcaaggcctgcccccgcgtcctggcgttcatggggtgcggcggctccggtgggcggcgcgcagccgccacggcctcgtccggcgtctttccggcggcgaggctgatctgatgcacgtcggaaccggcaaggggggtcagcaccgcgtaatgcggcggcatccccgcgcccatgacgttggcgaccttgaacccgtcatggacgaccaccggcaacgcgacctcccgatcgccggacaggaccttggccgtctcaacctgcgccggctggccggaatcctccggcacgcctgggggttcgaccggctttttcgcgtggggtgtcccgggagcaaccgaaatggcggcgggattggccggccttgcggcattgccctggccgcccagcccaggggtttgcgcttccgggctggcggttttgggctgtccggcagcgacagcgaggtatccagcaacgttttggacctgtccaacaatgccggccgacgcctgctccccgatctccaccagcggaatttccccagtcggctgcgcggccgcctcctggcgtggggcctggggctgtccggcagcggcagcaagatatccagcaacgtggccgacctgtccaatatcgttccggagctgtccaacaacggccgttgtcgccttctcccccacttccgccagcggaatctccccggtgggcagcgcggccggggcagccgttgcggcatccggccgggcggaagccttttgccggccgtccgttagggacgacagggccggagcaccggggggcaccgggccagcgtcttccaggaagctgtcgagccggccaggaaacggcgcggcatgggattcctgataacgccgttccacggcgtcaggttcgttccagccccgggccgcgtcttcggccgtcacaatggccgcaaccagcgcgtcgctcttgatccggtccggtttgtcgatgcccaggccggcggccagagtgttcaattcgctcttggccagggccgtcagggcggccgtccggtccggcccgcccagagcttggcctgccgtggaggtgtcctgcgggaggggctgagagacttcggccacaggggctgcgccggccaaaaaatcgtcctgccgtcccggaaaggcggcggcgtgagcctcccggtagcgcgcctccacggcatcgggctcgttccaggcccgggccgcctcttcagcctgcagcacggccgccaccagcgccttgcgcttgatccggtccggcttggcgatgcccaggccgacggccaggtcattgagcctgctcttggccagagccgtcagcacggccgcccggtccggtccggacggggcggctgctgcggactcctccgcctgcggcatggattccggcccggccggagtctgctcgccccggcgcgaggcctcgttctccagggccgccaaggcgtcgcgcaactccaggctcgggcgctcctggaacaacgccccggctcgtaacatggcggcctgcagatcctcgtcggaaagctgcccaatggcctcgggctgggccgcttcgccgatgacccgggattcccgccgcgcccggcgcgcaccgggtgaaaagtgttccgccgcgccgccaagccccatggtggccagggtcgccacggtggtttgcggagcgatttcgccaaacgcctcgccccaggtcggggccgcctcgcgcaaaccctggcgggcttcgatggctccctgttcatgctgggtccaggcttccgtgcccagctccaccggaaggtccaggccgagcttgaccccggccgtggccgccgcccgggccgcgccgttgcgaataaagggcacgctttcgaccagtttgcccaccggcgtcttgaggatgccccaggtcagtgcgctgcccacggcctcgggcacggcctcccacaggccgtacaggctcgcgtcggattcgatggcctttttcgcttcctgccaccgctcttcggacatggcgggatcggcctcgagcagccgccggcgcatgtcgtccacgaactggtccttggtcgcccggtagcccacggctccgctggccaaccccgcgccggccatgccggcaagtgccccggccacgttgcccgcgccgggcacaaccgagccggccagaccgccagccaggccgccggccaccatggagccggccgaatagcccaggttttgcaatccttcctggacgtccctggccttgatgacgccgaaaagctcccgctccgcctcctggggcggcaggttccagcgttccaggtccttttgctgcccggtgatggcccgcccggcaaacgtctcttcgggccgcaacggcacatcgccgccgcgcacggcttctgccacggtcttgggcagcacgtcggccacggccgaatagagcccctggccgatcaccttgccggacaacctgacgtcgccccaaaatccgggctccccggcatcgggcaggccgcccacgcctgcagcggccgaccgccgggcctgctcctgggccaattcggcatcaagccaggcaagatccgccatggcgttacctgcggcctgcggccacggccggctgcggatcaaggccgaacatggcgcgaatccgcgcctgcatctgggcgttttccgcgtccacgtccctggcccgagcttcgccggccgcttgccggccacggatgaaccgggaaacgctgccctcgagctgaaacccctcgggcaacgggttgaaattctggtccgggttgcgggtggcgtcgcccgtctcggccgcgccgtcggccgatttctccagggccgcttgttgttcggtcgtcaaaaccgtgcggcctgtcctggccgtcgccgccggtcggcgctcttgcaagcccatgggcggggtttcgaagtttcgttgctgcaaacggtaattgccgatggcgtcaagctgctcctgcgtcaggctcgccaagtatttctgacggtcggcctggctgagctttcccatgtagtcgatggccccgccgggagtgaactcgggcgtgggattttcagcgtcgagatacgctttccgggccgcttcctgcgcctgttgccaagcctttcccagattgacgaggcgcagcccaccgggctgcatggtatcgccggacgacggaccggtcacatagtccttctcctccaacggagcgtcaggtaaaccgccctcacgaggcaagatgacgccgtccggcgtcatggcattgcccccagcccccggcttgccccccgaccagggaggcgttcccgatccctgcgacgccgacccttcctgcttcgtcgcggcatagggatattctccccgccgcaccgcctcggcgtgacggacggccggatcgttgggcacgttggtgatgaccatggccatctcctcgggtctgggcggtttccagccccgcacggcctccggcccctgattgaataacgtccgctggtacagagtggcgtaatcaggatctccggggttcggctgcaaacgcccggtagccgcgtccatctggcggtttgccagttcctggggactgaatctcggctgcgacaaacccgaaaccgtactgccgacctcttccaacccctttgccgtcgtgggcatacgtcgaccctgcgcatccacgccggaaacgcgttgaggctggcccgggccggccccttgcccaaagccttcgggaagtccgccgacaccagacaaaagccggcgcgtttcgtcatgagggacgatttcaccgcctctggaaacagccatcacggcaggaccatcaagcccgagaagtgaaggactggaaccgtcatccgggacaaacatctccagccccttttctcccgcgataaacggccgcaagacaggcggcctgccgccagagccgaacatcggcgtgctggccttttccaggtacgtttgcagcggcgacaggccgagcctcgggtagtccgtggcccaattaaagcccggtgacgtgctccgcatcccggtttccgggtcaaacgtcgtcaacggcttggtgagggtcgcccgccggtattgatcctcggccgccgctttcaccccctccagcccgagctgcgcctgccccaacgtgaaattcaggccggccacgcccatctggccggcgttgcgcaacgcctgctcatccaggccgaactggccgtgctgctgttggagcaggggctgctgggccacggacagcgctcgggagcccgcgtcctgggtcgtggcatcggcctgctgctgcaaaatatcgtacttccgccgcaacgcgttttggaaaaattgctgatcggacatggcaaccccctaaacgctggccgtgtagttatagttcgtggattcgctggtggccctgctcgtcgccgtgctggtgcttttgacctcgctggttgattcgctcacgctcttggcttcggacacggattccgaccagctcgaccctagcgacacggcggcgtggaccatgctgccggccgctgcgaagccctggccggccacctgagcagcggccataagtcctcggccttgcagatcggcctgggcctgggtgcgttgcagctccagcccggcttccttgagggaggcgtccagcctggcctgccatttctgcacctcggccacgagttgctggatcttggcctgattctcggccgacacgccgctgacctcggcctgaaacagcgccacctggttggcggcatggcgggaaagcgcctcggcctgcccgagccggccctgccattcggcctggaaggcctgggttttcgccgtgaaaagctgcacccgcgaggcgttgagctggccggccacgttggcccggatctcgccgatcctggccacggccccggccgcctccacctgcccctggtaggcccgcacctcgctttcaaacgcctcggcccgggccttttcgccagtgatccgggccacccgggcgttgacctgggccgtcaccgcgttcacctgcccgatgtaggcctggacggtcgtttcaaaagcctggatgcgcgctttatccacctcggcggccacagccgcgccttccatgcgcgccttgtaaatgccgataatctcgcccacggcctggaccctggcgacatagagggccacgtcctgctggcgcagctcgccgcgaatccgcgccccctccatggccgtcttgaaggcctccagatcggccagggccgcccggatgcgcgcctcgaacacggccgcctcggcagtaaaagccgccacctggcagttaaaaagcgccacccgggcgtccacttcctgataagcgaactgcgccgtggccttggccgcctccagggcgcggtcattgcccttgttgaacacgtccaggcacacgcccaccacggcggccagggccttttccacggcgaactgacggctttgcaccgacagatcggccttcttggcggaaatcgtattgagaagcccttccagggacttctcggcgtccagctccaccagccggaggcgctcgtgagcctcgccgggcaggcgctcgtagcccatggccgaatactcggccacgatctcttccttgcggcgctcccgctcggcgaccacccaccgctcctgctgctcgaacacccggcccgtctccaggatcgcggccacgtcgccgccgttctccaggtcctccagcaaccgctggcgcagggccgtccacagcggggactcgaatgccccttcctcgtagacgaatacccgccccggcgtttccatgtcgggcagcaccggccgcacgccctcgaattgcggctggatgagcgacggcagggccgggatgtccacggcctcgaagaccggaacctcgggcagctccacgtcaggatcggccggcaaagccacatcggccaccgtcggcgcgggtccaggagcctcgggcaacgtcaggtcgtcaaaccccgggaagttcagcttcggcgcttcaccggaaaagatcggcacctcgacgtccgtaatggacggctccaccagcgccggaacatccggcgcgaccggcccggcgacaacgggcgcagagagtccaggcgcgcccggccgttgcgtcaacgacacgccgtccggctcgcctgacacatcaaccgatgggtagccgccgacaatgaacagcgagccaagacgcgccatcgccatattgacagcctgatacatgtcgcgctggtactgcatcgcgctctgctggatcgtcccaatcgctccactggcgtcgttgctagccaccggctacccccttccccgtcggcccagggactccagttccaggtcgatgccggtcacggcaaaatccccgccgtcgccctcgatgcgccactgcgcctcgcggcccgggccgccgccgccgccgcgcagggagaacgccccgcgcccggtgcgcagggcctcgcgccactcgccgtcgcccaggcgcaccgacagcgccaggctgtcctggccgctgcccaggatcgaggccgaccgcgcccgcttgaaagcgtcgtcgccgccgtccgtgcgcggcccctccaccaccgggcagatgggttcgcccgcgtcgtcgtcgccgccgacccgatacagcccgtccggcgtggtgccgtagaccaggccgccaagcgtcagaaagctcgtaaagggctggttggtgaactggctcgccgcgccggcatcggcggcgtagaccagacaaagcgtgttcatagccacctcgaaggatcgtgggaaaggaccgctgaaaaaccagggacgccctggacggcgtgcccgcgcacctcaaaaagcggcaggaggatctcgccacgggccacggactcctgatgcgccgtgccggcgacctggaacagggggagcgtgaccaaaccttgggcagacggcccttgcgcgccccgcccccggatgcccagcagcggcaacaccacctcgccccgggcgcggttgtcctggacggcgtggccccggaccacgaacaacggcagcatcactttcccattggccaggttgtcgtggtcggccgccgcgttgatgcggaacagcggcagcgtcacggagccgcgcgcggcattgcagcagcggccggaaacatcgaacaacggcagcgcgcattccccgttcgcgccgccccggccgtccaccgagaacaacggcaacgccacgtcgcccgtggccgtattggcttgggaagccgtgccggaaataccaaagagcggcaggcccacagcgccgcgcgccccaccccgaccctccacagccagggtcagcccgccgtcgaaatcccgaaaaagctcgatctcgccttcggcatggttgccggtcgttgcggacaactggaaaagcggcagcgagaccgcgccggacgcccggttgacggcgagctgggcgtaatagccggccgagtccacagccgcgaaagacgtcgcggtcaggacatgggtaatgcgcgtgtacgtctcccgcatgtccagctggcgcttgatctggtccgccgtcacgtcatagggcgagggctgcttggtccactcaagaggaatccactcctcgtccgaacgccggcggtagatgacccaggcatggccgatctcggcaaggtccgtggacagggcccggccgcaaagcgtgcgcacccggcctggatcgaccccggctgccagcagcaaggcatggatcaggaaggccccgtcctcgcagtcgccgtatttgcgcttccaggtggccaccgcaccggtccagcggtcgccgatgccggaaccgtcctgcacgtaggtcaggagattggagacgaaatagaccacggaaatggcgcgctggtcgtcattgtcgtcgtaggcgcaaatccgcgccgccgcctggatgagcgtgtcatggccctgctgcagcaggctgacgacggccgccgacgtggccccgctgtcgatgggcgtatccaggccgaaagaaatcccctcgatcgcaaagagcggcagagacacactcccggttgcccctccccggccatcaaccagcaacagcggcagcgtgtcgccggcagacgccgggacggccgccagtccttcgatggacgcgaagaactcgaagagattatccatgggtcaccacgaaatacggatgccgcacggaccaaatcggcatgctgatgtactgaagggtctgcaactcccctgatgcggaaacgattttgatgacggtctgatgcacgaacagataccactgcccgaaaaagtagagatactgcggcaaaggatcgaactggttggaatagatgaattcgcggacgctgcccgcttcggcgaaggccacggggtcgctttcggaagcggcgatgccggtggcgcaatccacggccgcgacaaagggatcgctgtagccctcggcgtcatgccggacaaggtgtttgcagacgttgaaacgcagggtcgtgtccagcgccgtctcgcggtaaaagctcgtgaatccgtcaaaggatagcttgagggaaaattcgttgtcgctgcccgtgtcggaatagatcatggccagatcgggcaacggactgcccggggacagcacgccctggacaaagccgctgtgcggcgtctgggccagccagagccgggtgccgcagctggctccggccacggcctcgccggccctggccccgagccggacctccagggcaacggggaaatcggcaaagtcgcagtgcgccgaggccgggtactcaaactgcatcgtacacctcaagcgaacacgattggatggtgaacgccgcgtccggccgagtcgtggaatacatctgcatctccggatcaatcagcaggccatcccacaacacttcacctccggactcccaagcgccgcttgtccatctgtacgtgccgtcgacatacaggcgcgaagtgaaattcttataaatcaacaggtcataggcgtgccaacgcccatctggaaagacaaacccgctttgcctatgcacctggacgcctcccgccctgacgtccacgcaccccatgtcgccccaggtgaacaggttgaagccttcgccgccgaaggcgttgttcgtcagccaaaagacaaaacggacctcgttggtgtaatcgtcttcaggataccgcgcgccgaaatccggcatcttcgccacaagccgcatgtgcagcaccccgccccggaagacacccttggcgcgtatgtactggctgaacttgcgctcgtagatgccctcttcgggcacttcttcataaaccgtccgagggacgaacgcgggcgtgccgcgaataccctccacgacgtcgtagacgccgagcggcccataacctgaatccccgggcggttccatttccagcggccgcaggtcgtctccccgcccgcagccgacatagatgccccgctcgttctggcaccagcccaggcgggccggcggctgcggcacatacagttcgttgaagcggtgggcgccggccgccgccagcaacgcctcacggtccgagacgccggcagatccgggcttcaggcagccgatggacgtgcaacgctcgtcaatgatggacatgcaaaccacccttacaccgtgatcgggacatagccggccgccacaagctggccggcctcctggtcatccgccacgaacaccccgtccagcacttccatggccagcaactgcgcctccgctttggacagcgcccggtgatagaatcggagcaggccgatatccatggaagatgaatacacccactccgccacttcttctgattcaggacttgttgcttttggagccaacacccaactatccgagccgaccattatttttacaccccggccaaatccgtccatattgacgtacgttccagtcgatgcgattccagatttcaaattgatcattttttcaccgagcctggcgacatacagatttacatttccttctgcatcgtatgtcattaaaacatgatgccaaaacccaatacctaatggctctgagacaacagtatttaagttgtactcactttcaaaatcacaaatttttccggcaataattctatctccattaaaccagcacagccccataatgttcatgccgataatgtagccttccgggtgcgcaacaggaaatggctgcatgccaaacgtcacgtccggccgagcgtctgccacaaaccgcttgtactggtagtctttcagagtgaagatagtagccttaatcgaattatcctggttgcgctcgtattcaacagaatagacagtggcatacctctttccgccgtcatcaagcgaggcaacagcccgcgttccgaccgccttgccgtgatcgccttcgaccttgaacttgaagtaagaggcatagggcgctgaattttgtacctcggcattttcagaccagctcgacacaaaatcgccgttcagcgtttcaaggtcaccggtcgtcaccttgtcccaatacggagaggccgcgtcatattccgatgccagcagcggttcatccggacatacgcttccgatctcacggcagcctatttgctttttgacgccggctacgaaatcgtcgttaaagctcggccagggataggtgaagttggcccaatggtttgaaaaccgggaaggaatcttgtagccgaccagcggggcaaggctcccggggcaggccgacgaccacgtgacgccatcttccgaagtcagcaagcgcgctttgatcgggttccagacggtgtagccgttaccgagttccgcagtgcggtattgaaacgagtagtccatctggatcggctcgcgcagccgcacgacgcaggagatggagaacgatcccttcgccggaatatgggcagaggccatcttaaactgcgaataatactcaccggaatccggccccacaccttccaaccaacacgtccggtagcgtcgggaaatggaaccatccggcgaagtccccggaggcggcaggccgacgtcatccagattttcgaagacggtcccaaacccctcgtttgacgtatcgccgtcgaggcttccagccttcagcagaatctcgttgtgcagttcctgcccttcctggaagccatagcgggcaaaacacccagggacccaaaaaaactgcccgcccgacagcgtcggcacgagttccggcgcaaactggccggcgactatctgtcccaccgggcaatggatgtgcagctgaaaaatgctcccggccttgtgaacctcgatcacggtgccgtcgtcgtactgacggcttgcggagcaaatggccaggtcccccgaactggcgaccaagccagctttcagttgccgggcggccccacggaacatgacggcgcgctgccaatcccctgtcaaagaccagcaatcctgatccggaaaccggatcaagtcctggctgtcgggaagcagcggcgaaacgtcgtcatgcctatccatggggtcgtcctgcgcataaggccagttcaggaggccggcgtcacaacgtcgaagctgtccacggtcgtggtctgccccgcgacaatggccgtggaagccagcttgagctggcctgaacccgtgccgcacacgccgtccaggcgcggcgcggtcgcgctcggccccgtggtccggtcgttggcgtacagccggaaccagcccgccgtgccggacaacaggcccaggcctgaccagacctgcgacgacaacttcggcattgatccggcggcggcgtcgccgaactgcaaggcattatccgtcgaaccgggggtgaacacgcccgaggaaaccgtgatttccaacaggggactgctcccttcggtgtcgtcagcgctggtcggctgcgaaccagcgaacacccggatgacgccgttattaaagatggatttgaagctgccggtcgccaggatgccgttacgcagcccggtcgagagtcgaacccccatggctccctcctacggatgcagcacgaccacgtagcgccgcgtggacggcagccagaccgccgccgcccgcaaggccggcgcgtccatggccacctgcgaatgggtgaggttgagaacgacgccgtcggccaggccgccgtggatgccgctgcgcgacgtccacaggcaggccgccgccggcggtatcctggatgaaagggcatcagcccgaacggccacgtcgctgcccacggccgtcaccggctccgggctggccagcaggcgaggcatccccttgatcggatcggtgccggccagaaaatacacgcccagcgccgtgccgacatacaggccgttgtccaccggccgcagcatggcgatgtccgccggcatggggatggagccggccccggtcttgtagaaatgccagcgcccggccccggccgtgtagcgcagatcccggccgtcggcccaccagacccggccggcgaatccggccagcacgccgccgcccggagccggcgacacatgccggccggcctcggaggccacggggaagagcttgccgccccaggccacggcctgcccgtcctggatcagcccagcctccacgccgttgtcccaaaagaccagatcgcccagcgccgcgaaccgtaccggccccagcgtcgccagggtcgccagatcccgcgtggccggccctgggcgcacctcgcacagcacgtgatccaccacggcataggccgtgccgtccggcgcgttccaaccgtcgcgccaatggccgtccgccaccttcacgcgccccggccggcgggccaggcgacggccgctgtccaggatctccacgtccgtggccacggccagggcgcacgcaccgcttcgccggtcataggccacggattgcggatcgctcacggtatcgaggccgcgaaagacgcggaaggccaggcgcatcatgccaacagcctctggctggttcccgatggcccggcaggcggcggccgccaacccgaagacacgatgtccagcttgagcgcccgtagcccttcctcaaacaaggcccggtagtgcagggcattgcgtttgccctcgaaagcatcttcgcggctgtcgaaggcacgggccaggagtccgggcagcaccacgtcgcggtgcaggtattccggcaccccttccacggccttggcttcgatgttgaccaggacggccgcttcgtccgtcaccgcctccgccacccggcaccacgcgtccgacgccgcctcgacggtgtacgcgccgtcattggcggcgctgccggacaccgtgaacgcatcgccgaagcggaaccggtcaaagcgcggggcatcggccgacagcagactgccagcggcgcgaaacgccacgggacccgacgtctgcgccatggtccggggcagccggaagtagctgaggcggatggcctccccggccaccggcgcaggccagacgcgcaggccgttgccggcctgggccacatgccggatggccccggccgcctgccgctccagatcgagccgccggatgtccgccggggccgtgacgacaatgagcttgcggccgtcggctccgacggccgcgaacagatgcttctggaagttgccgggcaaggccgcgccagcggctccggccggcacggccacggcggctgcggcctccagatcgggcaggaacacccgggaggccgccagccgcaacgcctcattggcgtacaggtccagctcctcatcctcgaaggaactgtcctggaggggccgccgcgccgcctggcgcaggtcagggagcagcaaaaccgttgcccccggtgtgttccccgccgctggcaggatcggccgcttccggcgaggccaccgccagcgggacctccaccgtgccccgaacgtagtaggagtagcgcttgaccgaaggcgcgacgtgcatttcgccggcaatctccatggaatacccctgggtctcggcgttttcgagcacttccagctgcgcggcggtcagttgcaattcccggccgcgttccagggaacagcggaacccgttgacgaacagatcgatgttgctgcccccgccggggcctttttcgggattgatcaccacccgatagcgggtttcggtggccccggccgtggcggcggcgctggcgtcgttggtgttggccattgggctgcctccttacagggcctcgcccggcacgcagccggacaggccgacataggtgacggtcaggccggcggcgtccagggccgtgacgcctgccgtaaacgtcgcgccggaaccgttggccacggtgacggcccctaacaggcagctgccggccgcaggcttggggatcctgaccactccgtggctgtccggcgaaaccacggccacggccacggttccgtcggccttgatggttatgaacgcggtcctggaccctccggcggccacggccccgagggccgccagggacaacgtggcgatggccgccttgctgtagatccgcccgcccagccggaacgaaaaccccgaggtcatggcgtcggcgctgccggcggccttgatggataggcccggatcactggccgcgccgtcccgcgaggcctccagcacggcagccgcagcctccgaagggaaccctttgaaaaaaccctgcagactcatgttggcctccttggctgatcgcggcccgggctagaagctagccgccgcttcgacgcggatcataaagggatcgttgaggatgccgccggcattgaccagtttgtagcccatggtaccgcgctggccgatggggtcgccgtcgcgcgccacaccggatttgagcaccagcagcttcaccggcaggatcatgtcgccgctggcgtccgcgtttttcatggggaagcccttgaggggcacgtccgcaaaggcgtccttgccgcaaatgagcatggggtagacgtcgcaattggtgccgctggtggagagcaggccggcggataccgcgccgccggcatcagcgaagggctcgaacaggtcttcgaggaggaagcggatgccggacaccatgccgatctcgttgtcccagggggagatgttcccgtacttgtgcaccgggatgaagccgtcgatgtcgcggatgtcgttagccatgtacggatggcagaaccccacgaagcacggcggaatcgcctcggtgccgtaggcggtggtgctccggaccatcctggtgtggcgctgggcccggttgaccacaagcgcggtctccacccggcgcagcagatccttggtgaccacggtgttgaccgccgaccgggaagcgccgttggcgtagaagacgttggttccggccatcaggcgggaaatgcgcacgcgctcgatgagttcggccgcgtgttcgccaagcaggccggcgaattcctgcagcaccggatccttgtgggtcagctcgaccatgtcggaaaagccgagccagttgccgtactgttccagggtgaagtagatgtcttccagggtgacgttcaggccttcgggcgtgacgccttccgacaggggctttcggaccaccggaatggacagataccgccgcgccttgaccgtcatgctgctgttctgggggatctcgatcacataggcgaaattgcccagaatcatcttgaacttggcgcgttccagaaagggcttgtgcaggtggacttcttccgagtccggcagttcgctcttggtcatcaggttggacatggcgagacctcgttagctcccgtagaccgcctgaatcgcttcggcgcgcgcgtcccggggcgtggccctgggctttgcgccgcgcttgttgtccacgccgccggccagggccgcgcggcgtttggcgtcgtcgccgagttcggcggaacgggaagcagccagggattgcttgtattcggaaagcaagaggttcacgtcgttggcgttgccgcgcgccaggaccgccagggcggcgtccctgtcctgggggtccttcttggtctccagggcccacagctccacggcgtccttgaactgccgcgaccggatccgttcgaccggatcgttgccgaacaggccgcgcacctcgggatgctgggagacgatggcctccacatgggcctgggccgccgctgagctggtttcggacgcccgcgcctgcttcaggctggcgagctcgtgttcgagcacggctaaccgtgcctgctgcgcggccgggacggctccgaacttgtcgagggtcttgcgcaaggccgcacccagggaaccgggatcgcgcaacagcggcgcaagctgcggttcgagttcgtcgaactccgccgcgtcgcccttgagcgcttccgggatctccacggccttgggcacttcctggccgggcccggcgggcggcgctgccggcctggcggcccgcagttcctcaagctccgcccggagggcggcaagctcctccttggtggcgcgtagccgtcccgacatagtgagggcgtggggcagcacaccggacgtttcgccgccctggtcgccgtcgatgtccggcgcggccggcccgccttccccggcttcggccgggggggccaccggatcggcggtatcgccgctttccggggggctggaaagtccggcctcgctggcgggctcctccgctccaggctgggggccgccggcggcaacctcgccgccgtcctcggggtcgccgtaggtgctcgccacggcagcggcatacgccgcgtctcgttcttcctgcttttccatgacttcctccgtcattccaggagccgtcgggcgggcctggacaccgggcctctttcgaggtgccgttatgctgttccggggtagccggatgcttcccaaaggcccttgctgcctgacagctcctggcgcaggcagcgcagggccatgatctggccctggagcttgcgaacctgttcttcggcgcaggattcgagctggcggcaatactgggcgatgcccaaatcgatgagtgccaccacgtcatgcagcaccggcccggcctggctgtggatccgccggagcagttcctgtctattggctgcggccataaaccttccggatcgcctcggcccgcttgctctcaggagattccacgcccagggcctcgatctgcagcacgacgctggactcgtctccggtttggtccgccgtgctgttgacccgcgtcacccgggccctgcaggccagttccacggtttcccccacgacaaaatcgccgaccgagcggccgagcttccgaagcgatccgccgtccaaggaaaggcccaatccccacgggaacttttccccgtcccgcgaggcaacggcctgccctttcctttccgtcttccgctccgccgccgtccgggccatgctcacaagcttgctcatgcggcctccgtaagccccaggccggcggtcggcggccgtgaggccacgacgcgcaggccaaagtcgccgggagccggggcggccggggcttgctggggctggggttgctggacggccatgccctgcagggcttccgccaacatccgctgcaaggccgcatccggcgtgatgccgcgcgagttcatggaattgaggagcgtttcgagcttggtggcctgttcgatccgcacctgcatggccatctgccgttcctggttgagctcgaccgtggcctggtcgtagacgatgtccgccgggatctgcatggacgtggccacctggcgcagccccttgttgacgtccagcatgggcgcgaactgcggattcgaggcgcacatggtcatgaactggatgagccgctgggactgcacttccttggacatgagcgccgtcgccccccgggccaccaccgagaaatcgcccttgatgtccgggcgcggattgaagtccatgttccagtggtacagggcggtgacgaactgcgaggtcacttcgtcgtcgaagatcttgaccatctcggcgaggttgatgctcatggcgttcatgagcatggacaggccgcccagggtgcgcgcggcgtcggaaacgttgccgtcgccgtgcacccagcgcggcacggtcagctcgtcgcccatgtcgtcgaagtatttggccagggccaggtagtcgctggtgtggctcgaggcctgccaaaaggtgatggccttgctcatgtcctcgccggtatcgaacttgagccatgtgccgccacggatgttgtccgcgtccagggtctgctgcagggctgggacgttgaccccgccgatagggcccagggacatccgggcattgtccatcatggcccggaccacggcgtttatggcagactgggcgtcacgatacacccccgtgacccccaggccgcacaggctggagtcatcgcggaacatgggaaaaatctggaaaggaaattccacgccccggatcggggcgcgcaccgccttgatgatcttgccgccaagcatccaaacgttgcagaaatagtcggcctggaccggatcgttgcccaggtcgacgccgcactcctccaattcgtcgccgcgcagccagccgtaccgctccaggacccgccagcggccttggagttggggttccggggtgccgccattgatgctgcgcagctgggattcaaagtcgtactccgtggcgtcgccgtcccgcttttccgccagataggccctgaccacgtcgccgtcgaaaccggtccggcccgccagctccagcacatcaccgtacaccatccggtattcttcgtagccgtaccggcaatcccccatccggcggttggccgactggtcccaataaaatgaccatggggaaacccggcggtaatacgggcggcgttccaccggcgaggtatcgagcacccaggcttcgcgctggatggcccggccgtcgacgcccggctcggccaccagtttggccgtccagacccggcgtttgcgctcgtccaccaacggccccttgtggatgcccatgccgtagatggccccgtccaggatgacttcccggatggtggcgcggtagccgacatggtccgggctttccgccagttggtcggcgatgacccgggacatggcttcggagcgctgcttggcgatgtcctggaggaacttcacggcttcggcgtcgccataagcacggcgcaccccggcgatgaaatccatcatggccggctccagcaccggctcgggcgtgggttcgatggaccagttacggtccccggcctggggaaacaggatctccatgagcctggacacgatggtgtccaccttgacccggcacttgttgacgaacagcttgctggcgtttgcgctgaagctgttggccacggcctcgtcgtactcgcccatgtacatgcggtagcgctccagccacttcatttcccaaggctgccgcgcccgctgggcatcccggaactccttggcgagcttggaggccagcagggccagtctttcgctagccatcgcggcgttccttggacggccggcaggtgaaggccacgccgtcgcggtagtcggtgaggcgtttgacgatggcctggggcagcgggcagccgagcgcccgcaagtgccccatgatggacagcatttcgtttatggcgaggtagaggatgatgccggcccggaagtcgaagtgcagccagccgccggccttgaaattgagcatggaatccagggtcacggccgcgaaaatggccgccgcgtacaggaagaacttggacaggccgcgcaggaagcgccgccgtgacaggcagccgtcgatccaggcccgggtgaagccgagggcgaagtcaaagccccacaaaagaaacaggccgcttgtcagcctgtcccagcccccgagcaggctgcaggccacggccaggatcgtggaacagatcgtcttgcccagccagccgaccagcaggtcccggccaacttcgagcaggtggtcccagaccagcccgaacatcaggccgcccccgccagttccagggcccgtacggcctcggggctcccggccagctgcttggcggccagcttgaggacgcccagggatttggcgtccgttgcgtccatggccacgggttcgggcagctcagcctgcagccggagatagccctcgcccagggtggcccggcagtccatgtccaccagctcggcctggccggcaaacatgacgtcgagcaggcgcggagcccactgggccaggccataggaccgggccgcctccagcaggatgggcttttcgcaccgccccgtgcccagggaaaccagccgcacggccgacagcggcgcgcccagggccagcccggccaccagggccagacgggccggattgttggcgaccacgccgccgtcgatgcaggcccgctccaagccgccaagggatttgatgcggcagggctcgaaaaaggtcggcgcggccgaggtggcccgggccacgtcggccatgcggtagaacccgccgccccaggaggtgaacagggccaggtcgcgcatctcgatgtcgtaggccacggccatggcccgggtttccacgtcggacagcatccggtcgccgaacacttcccacaaggccacttcgagttcgcccgcgtcgtagagttcgtcggccatgccaccaagggacgccaggcgttttttgagggaccgcgaaaagatggccggcccgcgctccaggtagaactcggccagccgcatggccggcaggccggccgcgaggcccagggcgaggatgccgccggtggaggtgccagcaatgaggtcaaagtgccggctgatcgactggccgatggcgttctcaaaggcggccagcaccaaggccggcagcaaccccttcatgccgccgccgtcaatggacaggatcttcacggcttgcctcctgcggccccggggtcggcgctggcggcgggcggcggcccgggccagcgcagagcctcgggcccgaagacggcagcggcctgggccgcctggcccgaggctccgccctccccttggccctcggccgtttccagggcctgggccacccggcggcccaggccgtcgccgctttcgcgcaacgcctcgagtagccggtccggataggacggccggcggcagaggccgggcggcgacgtcgccggcccgatgggcccccgggctgttttgcggccccacagcgccagccacaaaaagcccgaacccagggcgaagagcgccggcccgatgcttaccggaatcaacagcggcgggctgtcgtcgaaaccgcaccagaagcggtgcggctggctcgtgtccatggcgatgagcgcggcgctgagcagccactgggccaccgccccccaggcggtcttggacttaagatagccaagcaatagcgctttaacgtccatggcccacctccacgccggcccccatggcccagacgtcgatgtccaggccgcccgaggcgatggcgaagcgcagcttgtctaggaatcggctgtccccgggccgctccaggatcaggacgatcccggcccgcttgcccgtcgccccggcataggccagggactggcccacggcttcggcccacttggccgcgaaatcgaattccacggcatggtcggccgtttcgcagtccacccgcaggcccgggcggggcgtggtttccagggctccgccggcttcggcgcaccacaacgcctggtagtgcttttcgggacgggcatggccggcccgggccgcctgacagcagaacagcaccagggccgtggccagggccaccagggccacccggggccggcggtagaaccactcccacacggcgcaggcccgacgggccgtggcccgggacaggccccagtcctggagccggcaggccacatgcagcggattgaacagatgccgcaggccttcgaggagcttaggcatggggcagccctccctcgataaaggccgccacctttggcggatattggggattggtgttgtgcgtggcggcgtagggcccgccgttgtaggcgcgcagcaccccttcccagcccagggaggcgaggtagcgcttggcgtagccggccagatgccggcagccgatgtcgatgttgagtttaggatcgtgcagctcgttcaaaaacgcgccgtcaaagccgcgttcacgggccaccgcgcccatcatctgcatgaggccccaggacgcctgctggccccaccactcgcagtccggatccacgccacgggcggcggcctggaaatccgccggcggccgttcggaggcgatctccgcgtcggtcacggcccggaagggctttttcagcctgcagtcccaaaaataccggtacttcggttcgggattccaggcccagacgttgccgccgcccgactcgtgccggatgacggcgtagacgatctggggcggcagcccgtggacatgggcggcttcctcggacaattggcggatctgctcctgggtgacgccgaaaaacgacatggcggcctccgtggggcggccgccatgtccgggacggaaacggaaggagcgcggggcaggaggcggcctgccttgcagaccgatccgtaccacgcgtttttcggccgcccggccgggtgtaccgaaaataacatggagtggttggggaatggtaagggagcgtaccgaagatgataggaagtggcagggaagatttttcttgacaagtattcataccggagcccctttcacgtcggacgcgtttcccgggccttgaccggaatcggggcggctttgttttggcgttcgttgtcccagcgtgccttgacggccttttcgcattggccttgcgctcggacagttctcgcgggtcaaaagaagacgtgctcccgatggcggccagggtggcgtcgcgcatctgctcgatgctgccgccgaattcagtcaggtaatggttgcaacgcctgacgatgtcccgcacggcgaaagttatgatccgatcaaggccgctgagacccgattgagagagaagcaggtgatccagcgtcttgtccatgtcgcgaagcagcatggcgttgttttagaccaaataaaggtagccgttggcgcaggacagccaatcctcggccggatgcggcaacggcggttccggcttggccgggatggcctccgcgggacctgggccgcccggacggcctgtctgatgggcagccttcgagaataacactgccgggtgctcagaacccccgaagagggtgggccatatttaggccaaagtcttgaacatacggcccacacccggcagcaaggatgtgcaggtgggagaaaacaaagaggccccggctgtcgggtggggtggaccgtcttcggtggaggtatggggcttcgtggtcgggaactcagccaaccgggggaagatagccaagggacttgacaggatttacgttgcgacagtatcggttttcaaattgtggccagccaacgcaacccacggatcctcagcctgagtgtgaccattagctgcatgttgatctattttttacagcgcacgagctaattactttaaataaaaaaacattcactataaatgaaaaagacattcgaaatatacgatgcctgcgctgaacgggaacaagctaaattaaacgaatatttcgacagtctcagccaagacggaattagcattgcttacgtaagatatgttggacatctttttgaaaagaagggatactgcgttgtttattatgggctccaaaaaaatgaaattgattctgacatagatattattgcctatgatgattttgaaactatcttcattaaatgtaaatattattgcgacgacggagcactttctcaaaaacacatcctcaaattctttgaggatagcctcttatggatttcactccataacacccatccgatcatagagcatggtgttatcattaatattattgccaccaatacaacattaaccttaaaagcgatgcagtgcgcttattcactcaatgtacaacgctacgacaagctttatctcgatacgaactatccgctaattaaatgcttattccatcagactcttggttatatctatgtcctcccctgggatgaaatatatgacaaagtgaatactaaaattttcatgaaaaccattaaagaggcagaaatggaatattcacctgtttgggcagctgaacaatatttataatagctcttaacccacaaagtcgaacagcataatgggtaaccccgaatctcttttcggctaccatctgccgaccccattgagcaaagaacttaagggccataaaaaaccatgcgcacgaagacccggacaatcaaggccagcctcattcttctgcctttttagtgaatttccgccgccacgccagcagttcttcccggtccgcgatgtaggaaaacccgtcaaatcggaccggcatgggcggagacacttctttgaggtagcggataaaccgtcgccgtccaatcccgagaaccgcgcaaatctcttccttgttgagcagcatcgtcctttcatccattgtcagtaccccgccctgccatcggccactccggaccgggtttgcgcgcggcccagcgcgggcttgcgctcgtcgcagtgagcgatggcccacatcagcgccgccaccgccggaaaatcctcaatgggccgccggatgtccttgccggcgtcctcgatcatggccaccagttcctggcggcccagcaccagggcgcttcgccccacgatcctggccgtcaggtagggggccaggtccgcatgcagctgccccccggctccgagcccgggggcgggccgcaggcgcaggggcggccgcccctcggcccgcaggcgctcgttgaggaaccgcagccgcttggcgtagacatgttgcgggtcgcccacccaggcgctcaccgccgaccgcccggcccatttgccggcaaggggcgcggcttcggccgccagcccgagtaaccgctccacgtccgcctcctggatgagatccaccagccgcaaggtccggtagccttccagggggtcggcctccaattcctctgccagggccaccaccgccccgggcgtagtccccttgggccagcacagcccggccacaacccggctgaagacggtcacgcgttccacgctccccgcctcttcgacgccgcgaatccgggacaggcctgtccagggctcgacaaaggcttccagtctcatcgcagctgcatccccgcgtaaaagctgttgctggaaaaatccgccgctatgcaccaatagttcagggcgtgccggaagtggtccggcccgagcttgacccaggtataggccttgctgcctgtttcctcgtcctcttccagtttcttggccgtattggcgcagtgggccgcaaaggcctccaccggcccgcactggcgcggcagcgccagcctcctggcagacagggccgtgtgggaggcgtccatggattcggtgcggttcaccgacacctggagggtcttctcgttccaggcatagccgcccttctgatgcgggctgtaccagttgaggaacacgcggccggggaagcgcccggcgaattcccgggcctttcgggtctcgggcatgccgtcgatgacgcagcgggtcacgccaaaggccgccatcagccggtctagctcctcgaaatcccggtactcggccacgtgcacgataaagccatcgcgccgaccgaccaccacatgcagccccttgccctggtcgacgcccatgcagcacggccccggatccgtcgccccgatgccgtgggaaccgcacagggccaggacctcctccttcgtgatgcggcaatcggcctccacgtagggcaggccgagcttgtagttgtaaaacgcgcccatgttgagcgtcgtgcggtactgggacaggatttcggccggcctgacgtactgcgaatagagctggctgtactggtagccccgccagtcctccaccgccggccggcgcgccacccactcgccccgggccggatccagcacaccctcgcggcaacgcaggcagcgcaagtccacggacccgtcccggcgctcccacagtaggtccggcacggcccgctcgcggggggcggcggccgcctcccactcctccaccacgtcggtccagcccccgcaccgggggcacttgagcagccagcggcgctggtccgtgagctggtagagccggtcgatgccgaaatccggcagcgtcgggttggacaggaaatgctcccacttgtggtcggaatgggccatgcgctcccgggccacggcctcaatgcccacggggaacaggtcgaactcgtcgtagatcacgaagtccaccgggtcggagcgcagcccttccagggacttcgtgccgcgaaacagcaggttcttgccgcgcacctgcttgagctccactgagtcggtgttcacgacgtaccgggccagggaatccgggttgcgctccaccagcggcgaaacgcgcgaccgggaaaacgccgacgatcccgtgcgcgacggaaacaagtacaggatgcccacgaaggccatgtacagggcgcaccagaaggcccgcagcatggcccgagtggtgttgcccatctgggcgcatttgagttcgacctgccggggatggtcgtcgccgtagggcagttccaggcattcgtgacgggagaaagagaaggggcccctgtccaggaccacccccttctgacaggcccacccccccggggggggcctcgtccgtgatcggcaccaccgtctgcaccttggtcaggaagtcggtcatgatcgaccggcttcccgtcccgccggacttgcgcgccatggcccctcctcacaccagctcgatggcgtacaccgaccggatctcgtccggctggatgcacaagtaatcgagggtctgcttctgggttgcgtggttgtacacggccatgagcgtgggaatgtccacgttgtggttcacgcgcatctggtagccgaaggttttgcgcagggtgtgcgaaccgtagtggccgggcaggttgacggcttcgcaccagccgatgaccatgcggcgcagccaggacgtcgtcagcggcccgcgtttgccttggaacagcaaatccccatcttgccatggcctggaggccaaaagccgctccacggccgttctgacggccttgttggcgcatatccgccgcagtttgtgctccttgctctcgcgcaccacgtcgccgtcgtccggatcggccaggatggccttgacccggcccacggtcagggccagcagatcgccggcccgcagggccgagtggatcccgagcacaaacagggcgtggtcgcgcggccggtcggccaagagcctggcaatggtcgccagcgccctggggcttttgatcgggtccacggcgatggccgagcccttgggcgcgtggttgttgggcggctttttccggctctttgtttcgtcgtctttcggaaccgccacgggctttagacgacgtccgtccgggccaggagccggcaccgtcgcggcattgtcttggcaacacgctgtattcatggcgaatccccctttttcggttcgtcgtcttttgggtaaaagacgacgaacctactccgacgctttgagcccgtaatcgagggcgttctgggtcgcatcaagcgccatcaactcttccacgacctggcgcgccagatccggcgcggcgcgctgcagcacttccatgaccttggcctggaactgcatcacgcgttcgatgtcgaacttggttttcttgatcgtgttgtccagttcgagcatcttgcggttctcgcccagcaaggcgatgtaggccttcagcagttcgccacgacgtccggccagacgttccagcttgcgccgggcatcggcgtcgccttccagcgactggcggaacagttccacgagatccgtggcctgccgggccagcttttccagccgttccagggcgtcatgctggcgtgccaacacctcgacctggacgaactgcgggctggccgcttccagcgccgtttcgcaccggcgcttcacgaccgacaccctggcctcggaaatgccaaagcgcagggccatctgcttctggttcaggccctccttgcggcaggcaaggtaatcttcatcggtgaacttcgcctttgccatgcgagccactacttcccgtttatgttgactctaccttacgaaatgtgttgattcaataaattaatatcaatctgcatcaacccgttttttgagttaaggcggctttgcattaaccgcttcatcagcaaactgacgttgtgctttgttcttctgcttcaacgcttcccacgcttcaacgctcattccctggcctctcccctcttcgttgcatccaggatctggttcttcagccttcacggcctggtcaagaatctgggcaaagttctcccggtaggccttggccgagaggatcctcgagcgccagaaggcgtcctgcagggcgaagcgcgtggcccgttcgatctcctcgaggctgtgtccggcctcgaggagccccaagagcatcgccggccacttgtccggggctttcggcctggctctggggctggacttggacatgaggccgaagaccagctctctcgctctctccccgtcaggggctagagagagagatttaagataagatgggatgggatggggcattgcagaacccatgcactgcattgcaggtgcatcggcattctcaacaccctgttttttctttgtttttacgaaagaagagtcgtcatttttctgccatcgggcgtttgccgctgcgaccttcacagggttcttctcaccgcgcgcccagatgttgggttgccgtttgtcccagttatgcacgacgacaaccctgtcttcccgtcggtccaaaaaaccaatttcaacaagatttgctacaaattcagatggatcgatgttttttgggtcgatacaacaagcggcagcaatgtgtctgtccgacatgttttcaagtacgcctttgttgcgttcttccgccacaaacgcccaaagcgtaaaaatggcgtcaatgccttcgctgccatatagctgccgtagcaggataaattttggatgtgtccgccatgtggactccacccggaagtcgtatcccattctgccaccgcctctgcacaaagttatccgacgcctgcatatccacattcatgcagctgcatgcagctgcatgatccctctcacaatggccgttcatccgactcaaatcgcacgtgttttcgattgtacgcgaccggcacatcgccggtcatggaattgcggcttttggccacggtcagctgtgtgaactggatgtcctcgcggcccgaacgatcccagggctggatcaagagaatgatgtccgcgtcctgttcgatggctccggactctcggagatcggattccaccagcttcggcgacttccgtttggccacttcgcggttcacctgggccagcagcaccaccggcacggccagatcctcggccatgagcttgacggatcgggaaatcgccgcgatttcctgttcccggttctggtggtggccatcgggcgggatgagctgggcataatcgataaacacgatgtcgagccccccgtcctgtcgccagcgacggcaggcggcccggatgtcggacggcttgcgtgccggcttgtcgtagatgcgaagcggcatctgcttcatgcgctggcagtgggcgtagatcctggaccagtcctcgtcggaaaacttgccgtcccggaatcgctgggccgccaccccagcccctgaggaaaacatgcggttaaggagctggtgcctgcccatctccagggagaatatcccggtgggatgcccaagccccacagcgtgctcggcaaaggtcagagccagggccgtcttgccgtggcttggccgcgcccccacgacgatcatttccccgggcatgaacgagcggatcaatccattgagtttccaaaacggcgtgggcaccccgccgccgcccgactgctccagcttttccaggtaggtcgtataggggtccaaaaattcatccggcgtctcgccatgggtatccagccggtccttgagcacagcatccgacgccatctgggcgatggctacaaactcagccggctcacgctccggatcgtaggcaatctcaatgatgcgccggcccatgcccgccatcgaccgacgcttggacatagcccgcacaatgccggcgtggtgcaggatattggctgccgacacgacacagccggccagttcggccaggtgggccgggccgccggctggatcgagctgtccggcggcagtcagcgcggcagccaatgtgatcagatccactggcttgttatcacgccacaggcccaccatcgcctcccagaccatctggtggcggggatcgtagaaatccacacggcgcagctcgacccccagtttgtccaggatcgacggcttgatgagcaccccgccaagcacggcctgctcggcgtcaagattgtggggcggcacattgcggagcagcatccctgtcaggtctgccggcccggagtcagggcgccggtttcgtggcgtggccataggctcccccttcgctatcccgcctgaactggctgtaaatctccccgcctgggagttacagacaccggacaagtcaaacggctcgacaacctttttgttgacaaaaagctatcaaaggttatcaggaaatcatgacgcgtattgagtggagccgaaaggcattgaagcaggcagcccagatctaccggcaacaattcccggtcatccgcaaggctgttgaaggcctcctctcctggccaacctgccaaaatgtcaaagccctggttggccgcgagggttacagacttcgcgttggtcgctaccgcgtccttttcaccgtccacgaagacgaaatccgtgtcattcgcattgaggaggtcaagaagcgcgatgaacgcacctattaagcaccaaattatccatggacccgatgggaatcccctgtacgctgtcatttcgtgggaagatttcgaggaacacttcgagggcaaggccgacgaggaggtctttatcccccacgaggtggtcgtgctcaacctcgaaggggatatgagcttgattcgtgcttggcgggagcatttgaaactctcccaacgcgaggtagccgggcgcatgaacatctcccaaccggcgtacgcaaagatggaagccaaagatgcacgcccccgcgtgaccacgctgaaaaagattgcggacgcaatgggcattgaatgggaacagctgcgggaaggatgagcgtgcagacgggggcagcctatgttggaaattacaaaaaccttccgcgctgacggattcgtggtgatcagcgtcgtagttccagcagatcgggttgacgacgtagtccgcgccatcgaaaaagctttggagccggacattccggccgaagaggcatttgccggttttgggccgggcgacgccttgcggggcatgcgtcgcctgcgcgaaatgacccaggcgcagcttgccgctgcaatcggcgtccacaagtcccatatctccggcatggaacgcggcagaaggccgatcggcaaggagatggccaagcgtttggccgacgccctgaacacttcgtacaaggtttttctgtgaaacgtccctacccggccatcctgcataccgacgacggcacaagctacggcgtgactattcccgatctgcctggctgtttcacctcgggcgacaccctggaccaagctcttgccgctgtccaagaggcggtggaagcctgcctcttcgatgccggcgaagctccccaggccagcccggccacggatgtgctggggatggctgaggccgaaggcggcctcctggcctttgttgaagtggacctgtcctttcttgaccaaaatcttggctaaggccctgcacacctcatacaaggtttttctgtagaaagagaacgtcgacagaggcaggagaacgttatgcatttccccgctgcggtcttcagtgaaaaaggcaaggcctacggcgtgaccctgccggacatccccggctgcaacaccgccggcgacaccctggaagaggcccttgcgaacgtccaggaagcggtcgaacttatgctggaagacgccaccgaaaagccggttcccagcagcgtggagcactataaggacgatccggtataccaggatgtggcctggacgctggtcgatgtggatatgtcgttcgtggacggacccgctaacggagctcatgaaagtgacgcgcaatgacgcgaccgcacacttcccctggcccaccaccaagccccgctccggcggggcttttcgtttcccaagcccgaaactggggtggtcggcccggcgggcagccccagcaaaagatggggtgaaaatcaggctgaacatggcctgccccaaataaaaaaagccccaaatttgccctgttttttggggcagactttggggcagactagacgagcgcgtatgttaagggcagagaggtgtgaaaaaatccctataaaatcagtttggtgcgagagggagggctcgaacccccatagcctaagccgccagatcctaagtctggtgcgtctcccagttccgccactctcgcacatgtgccccgcgcggggcatattttcttacgtgaaagatgcagccaagacaatcgccaaggtggcgcgctcagaaaattccgtccggatcaatgcttagacgcttgcttggccgattcggacaggtggcgctcatacggagccaagtggttgaccggcccgtcgccgtcgccaagatcccaggcggtttccagggccagctgcagatagtcccgggccgcctccaccgcctcgggcaaggccttgcccaaggccaactgaccggcgatgcccgccgaaagcgtgcagcccgtgccgtgggtgttgcgggtggcgacaaagggccgcgacaacacccattcccggccgtcggccagaaccagacggtccgtcaccaggctgtccgaggtctgcccgatctcgaaatggccgcccttgagcagcaccgccttggccccacgggccagaagacgccggatgacctcgtcggcgtcggccttgccgccgatgggcaggccggccagcagttcggcttcgagacggttgggcgtcagcagatcggccaggggcaacatgcgagtcaggatcgcctccaccgcctccggcataaggagccgcgccccggactgggccacgcaaaccggatcgaccaccacggggaaatccttgtcagccagcccctcggccactgccccgatgatgacctcggaaaagagcattccagtcttggccgcccgaatgggaaaatcggcccgcacaacccgcaactgctcggccacgaagcccggcgtcggcgcttcgatggccgaaacggcgcacgtgttctgggcggtcagggcggtgatgacggacaggccgtaacagccctgcatcatgaaggtcttgaggtcggcctggatgccggccccgccgccggagtcggagccggcgatggtcagcgcgcagggatgggccatgtcgcctccttggcttgatcgctatttcccggcctcgggcgtggcgtccagagcttcgtcgctctcccggatcttgctgagtttcagtccgcttttggccagcacgagcagaccggccacggtgaccggaatgtactgcaccatgtggagcaccaagccagtcgccagagcctgggctttgtccacgctaaaaagccccagggaaaagaccaccgccgcctcgaaaacgcccagcgctccgggcgaggacggcatggccatgccaagggacgaaatgacgaacaccgccgctgcctggccaacggtcaagggcaggtcggccacccataaaagcaccaaaaaggtggaaccggcgtagagaacccagcagaccagggtataaagccccagcacggtcatgaagctgggggtcacgccatggagcacctggagcttaagctcggccagaaattcggccagccggttggacggcagtttttcaatgatgcggccgacaaaatccggatagtggcgcaccacccatagtccgacccagatgccgcccacggctgcgcccagaggcacaaaagccatcttgaggttgaaatggaaggcgacgaccagtcccatggccaggatggcgtttaaatcgaaaaagcgctcccagaaaaccatggtgatgctgcgcgagagcgaaaatcggcattcccggcgcagatagaaggccttggccagttcgccgagcttggccggaacgatgttgttgacggccatggacatgagaaaggccttgaagcagacccagttgccggcgcaaaagcccgacaggaaattgaggcgaagggccatgacgccgtagcccacaaaggaaaaaagcaccgtccagaacagggccacgtcatcaaaacgggtaatggcgtcccacagttcggaaaaattgagtccccagaaggcatagaccagacagccccccaccagggccaagcgcacaaacaaactggcggctttctttacaagcatcgcggaccgttcctccatgaagccggggccgtcccggcgtttgggcgatcagacattgaaaagttcccgcaggcggtagttgaggtgcgtgtagcgccgctcgccgccggcgtttttgaggcccagggtgagcgcccggcggctgcccacgagcacggccagtttcctggcccgggtcagcgcggtgtagatcaaattccgacgcagcatcacgtaatgctgggtcaaaaacggggccaccacggccggatattcgctgccctgagacttatgaatgcttacggcataggccggagccagttcgtcgagttcggtgcggtcataggggacatcgcgcccgtcgaaggagacgaccagcgcgccctcctccgggtcagcggccgtgacatgccccaggtcgccgttgaagacgtccttttcgtaattgtttttcgtctgcaacacccggtcgcccagacgaaaaatggcgtttccccgaatgaccgtcggccccgaaggattgagccgcgcccgaagcgcttcattgagcgcctgggtgccggcctcgcccttgtgcatgggcgagagcacctgcacgtcgcgcatgggatcaaggccataaacctgggggatgcgctcggccaccagcgtggcgatcagatcgcgcacggcggccggatcgtcctgctcgacccagaaaaaatcggcctcgggcggctttttctcggccgcctgggggaactggccgttgttgacccggtgggcgttgaccacgatcatgctttcccgggcctggcgaaaaatgtgcgtgagccgcgcgctgcccacggactggctgcccaacacgtcctccaggacgttgcccgctcccaccgacggcagctggtcggcgtcgccaacgagaataagccgcgaggtaaacggcaaggcccgcagcatgtgcccgcaaagcctggcgtcgagcatgctgacctcgtcgaccagcagcgcgtcggccttgagcttgttgtcctcgcacacggcaaacgagccgtcgggcgtggactggagcaggcggtggagcgtggcggccggctggccggtcgcctcggaaagccgtttggccgcccggcccgtgggcgcggcaagtttgacttttagcgacagcttgtcaagggcggccaccaccatgcgggtgatggtggtcttgccggtgccgggtccgccggtgatgacaaagaccttgttggcgcaggcgtcaataacggcttgccgctgctccggggaaagctggatgcgggcctcggactccagggccggcaggagcttttccaccttgccgcgcaattgcgcgccgggatggccggccaagtcgtggatgcgccgagcgatctcggtctccagggcatagaagtggcgcagatagacggccgcttcgatgccctgctcgggcagaggttcgaccttgacccgcttgagttcttccaggccgccaagcccctcctccaggcgctcggaagccacgtcgccgaccagggcggcggttttctcgaaaagcacgtccttgggcgcgaacagatgcccctgctcgcccatggaaaagagcacataggccaatgcggcctggacacgctcggggctgtccgaggcaaagcccaggcgcagggccatggcgtcggcggtcttaaacgcgatgccgcgaatttcataggccagttcgtaaggattggcccgaatgcgggcctcggcggcgttgccgtaaagccgctggatcttggcggcgtgggtggtggcgatttcgtgggtctggagaaagagcatcagcgagcggatctcgttttgggcgtcccaggaggccttgatctcggccagctttttcttgcccacgccttccacggaaagcagcttgtccggctccttgtccagaatgtcgagcaccttctcgccaaaggcgtccaccaggcgcgaggctaaaatgccgcccacgcccttgatctgacccgaggccaggtagcggcggatgccgtttagggtggccggcatctcgcgcacggcggtggtcacctgaaactggcggccatacttgggatgggtggcgaaatcgccggtgacccgcaagagttcgccgggcgtgaccttttgcatgcgcccgacaatggaaaacggtcccggttcggccttggagccgacccgggcgatgaggtagccgttttcctcgttgaaaaaggtgacggtctcgatttcgaccgtaagctcgactgccatggggtttgcggcggcgtccgagagttagaggtcctggcgatagcgcagggattgggacagggtttccttgtccacgtacttgacctcggcccccagggggatgccctgggccagccgcgtcaggcgcacggccggaaactcccgctccagcagattcttgatatgggaggcggtggtttcggcggccagcgtcgcgccaagggccaggatgcattccgtgaccgcgccctcggccagtttggcccgcagcacgtccaggcggagttggccaggcgacacgccttccagcggatcaagcaggccgcccaggaccagatagcggccggcgtagaggccggtttcctccatctgcatgatggcgtcccactgggccacgagacagagctgttcgccgtttcgggacgggtcggcgcacaccggacagaccggcgtttcggacagcgaggcgcagtggacgcacaggcacaaccgctcgcgcaggcgcaagatggcctcgcccaggccgtcggcccgggggcgcggccactccaagagcgtcatggccaccttgagggccgacttggggccaaggccgggcagcttggccagctggtccacgagttcggccagggggacgggcagggtcgtctgggatgccatgttcgggattccgcgtaggggcgcgggcggcgggaaaaggggtcgccccttcccgccgccggttggttagaacaggccgggaaccttgatgccgccggtgatctgtcccatttcggcttccatcatggccttggccttcttgatgccgtcgttgacggcggaaaggaccaggtcctggagcatttccacgtcattggggtccacggccgtcttgtcgatggccagggacttcagttcgttggaaccggacaccacggctacgaccatgccgccgccggccgtaccttccacggtgcgctcctgcaggtcttcctggagcttggccatctttttttgcatgacctgggcctggcgaaccagttcgttcattcctttcatgggctacctcctctagcggggctttcgttcgatgatttcggcgtcaaaggccgtgacggcctggcgcacttccgggtggttgtcgacgtagtcccgaaggtcatggggcgacatgcggtcatttgccgcctcgccttcggtcagacgcacggtcacgccggggccgaaataggcttcggcggcttcggtcagctggcgcagcttgtcgggatgggccagacggccgcgatgaaaggcgttggtgcagctgacgaccagctcacccggagccggatcgggcgaaaacgtgccctgggcgtgcttgagggccaccatgtcgctgccccggccggcctggcgcaaaaagccgtcccaggtgcgggggccggccggcgcggcttggggcggacgcggcacgtcatcatgcccggatgatccatggccctggcccgaagcggcgaaagacgcagactggcctgatcccgaaggggcgtagccgccggcagccggcgcggcggccggggcctgggccgggggagtcgagccgttgcccggaccggacgcggcatggggcgtcggcgcttcagaccgggacaccgggggcgcggcctggggcggatagctccggggagcggcggactgcgcggtgggcggcgcggcgtcgaggccggcggccggccgaccgtaaccgccctggtcccgaccgggaccggtctcgggctgaccgtagggcgcaacctggtcggccaggggctggggccggtagccgccgggacgcccgccctggggctggcgcggggtcaacccgccgccctgccctccggaacgaccggacgacccgcccgagccaccgggaccggaggccgccggcgcggcgcaggaagcgagattttgcaacggcagcaggcgcggcagataggccatgttgagcagcagcagctccagggccaaggccggctccaggctcgtctggacccggcgctggccctccagggtcatctgccagcaggcatggatgtgggcggcctcgatgcgtccggcccagaccagccattccccggcctcctcggccggcagatcgaccacgggcagggcccgctcaccagcctggcgcaggagaaacagattgcgccacatggaggccagctcgcgcaggaaaaagccgatgtccaggcccttgtccaggacctggcgcaaaagctccaccaccgccggcccatcctcggcccggatggcttcgatgagtccgaaaaacacttcctggccggccagcccaaggacgccccgggcgtccgcttcggtgagttcagccccgcccagggccagaacctgggccaaaagcgacatggaatcccgcacgctgccggccccgcgccgggcaatgaggctgacggccttggcctcgtagggcacggcctcgcgcatgagcacgctggacagatgggcttccagctcgctctgggccagtcgcttgaacagataatgctggcaacggctgatgatggtggccggaaacttgtggggctcggtggtggccaggatgaaggtgacgcgtccggggggctcttccagggttttgagcagcgcgttgaaagccgccgtggtcagcatgtgggcttcgtcgatgatgaagaccttgtagcggctgttgagcggcgcgtagcccacgtcttctttcaggcgtctggcgtcgtcgaccttgccatgggtggcggcgtcgatctcgataacgtcgggggagaccccggccgtgatctgacggcattgggagcagacgttgcaaggttcgcccgtgggcgcggtctcgcagttaagcgccttggccagcacccgggccagggtggtcttgcccacgccccgagtgccgctgaaaagataagccggcgcgatacggtcttcggccgcggcccgggacaggatgcgtttgacggcgtcctgcccggccacgtcggcgaaacgctggggccggtatttggcggtaaggcttattgtgctcatcgaggcggtccgggcggctgcactacggtcgcagccgcccggtaacggttacaggctgtaacggcgcagccagttggcgtaggccgggttttcgcccttgaccaccttgaaaaaggcggcctgcagggccttggccaccggtccggcatggccttcgccgatgacccggcggtcgagttcgcggatgggggtcagctcggcggcggtgccggagaaaaaggcttcgtcggccatgtagacttcgtcgcgggtgaaaagctgctccaccacctcatagccgagctccttggccagggtgatgaggctgtcccgggtgatgccggccaggatggaggtcaagggcggggtcttgatgacgccttttttgacgataaagacgttttcgcccgagccttcggccacgtagccggtgggatcaaggagcaaggcctcgtcgtagccgtcggccagggcttcggtcttggccagcacggagttgacgtagttgccggccaccttggccttggtcatcatgacattgacgtgatggcgggtgtagctcgacgtgcagatgcggatgccgcgctccagggcctcggcgccgagataggcgccccagggccacacggcgatggccacgcgcaccgggttggggccggggttgacgcccatggcctcgccggagccgatgaaaatcagcggccggatgtagccggcggtcattttattggccttaagcgtctcgacgcaggcctcggccaactgttcgtggctgaagggaaccttcatgcccatgaccttggccgagccgagcaggcgctcgatatgctcgttcaggcgaaaaacggccgacgagccgtcagtgcattcgtaggcccggatgccctcgaacacgcccacgccgtaatgcagcgtatgggtcaggacatgcacgttggcctggtcccagggcaccatcgcgccgtccatccagatgaaatcagtccgaacacccatgatccaaccctcgtgctggagcgtttcccggggagcttcccggatggcgtcatgatggcgccgcatacccgaaacggaaacgcccatgtgtaggcgctttacccggccgggtcaaggcggctcggccgatcaggacggcagggccgccatggttgcctcgccccgcagttcctcgatgagcgcctcgatgacccgggcctgctcggacaggtcggccagggactgggccgcctgctccatggcctccgccgtgtcctgggacaccgaccccacggcggccacggccgcctcgatggaatccgaggccgctgactgctgctgggaggcggcggcgatggagcgcacctgatccgaagccgtctccacaagccccacgatggtggccagggcctggccggactccccggccagttggttggccgattcgatggcggtcacggcttcgcccacgccggacacgctacggcgcgccccggcctggatgtcgcgcacggcctggccgacctcggccgtggcggccatggttttttcggccagcttgcggacctcgtcggcgaccacggcaaagccgcgcccggcttcgccggcccgggccgcttcaatggcggcattgagcgccagaagattggtttggtcggcgatgtcggcaatgacgccaagtacccggccgatgccctcagcctgaccgcccagggcgtccatgtcccgggccagggtttgggccttgtcccgggccgtgccgatgccggccatggcccgacgcaccacgtcggcgccggcgctggccttgtcccgggccgaggcggcggtggcgtcggccgtggccgcgctttgggccacgtcgagcacggtagcgctcatctcgcccatggacgcggcggcttcggccagacgcgaggactgctcgcgagcgccatcggtggcccgggccacatggcccgacaaggcggcggcggcggcggacagggttccggccacctcggacaggcgctcggcggcctgctgcatgccgtcacggcgggcacgctcggcggccagacgcagcccgtcggcctcttccatggcctggcaagccttggccgcctcgctggccgcctcctcgccccgggccgtggccgcggcgatgttgtcgcgaagggcggcgagcatgcggcgcatggaggcggccagctcggcgatttcgtcccggccggacacgtccaggcgggcttcgagatcgccttcggccacggccttggcaaaggccacgcccttgcccagggggcgggtgatggacagggtgatgacgatgcccagagcggcggaaaacagcagacaggcggccacggccgccgtcaggaaaatcgtgcgccggtggacgtcttccagggaggacacggccagggcgtcggcctggcttcggctgcgctcaagaagaaagccgagcgcgtccatggcttttttctgggagagctgggacatgccgatggagagcgtgagcgcgttgctgcgtttgccggcggcgaccagctcaaggacttgggcattggtcttgcgccaggcggccagggcttcgttgaaggccttccactgggcggtctcttcctcatccaggggcatgcggtcgataatctcgcgcccggcgtcggccaaggctaggccggcccgaagattctcgcgctggcgctcgaattccttggagttggccagttccggcacgaggatggtgcgctcggccgactgggcggcaagcaggccttccttgaccatgcccagaccggccacgcacggcaaggcgtcgcccgtcacccgggacaaagccgacccgaggccgaccaggccctgatagccgagaacgccgacgaccagggtgagcagcgcggtgacgcacacggaggtgaacaacttgacgccaaccttgacgttgcccatggcattgctcctttctgcggccagacgcgaccacgtccagtctcagccgttggctggggcgcgaaacgcgccatctttgcagagccggccgcgccctgtcaatggccctgggccagcggcggttcgtccaggacgccgggaggtttttccagggtagcggcggaaagcggcggttccgtggcggcctctccccgggccagggattcgagataggccagaaaggcccgcccctccgggaattcaggattgagccgaagggcttgtcccagcatggcccggcagcttttcacgcgccctttctcaaatagcgtgcgggccatgttgtagagcaaatgttcgtcggtgttgcacaggcggtaggcctggctgtaatagcgcatggcctcgtcaaacatgccgagtttgcgcatctggatgccgaattcgttgaacaggtgcttgtgctcgggcgtaaacgccgcttcgatgcgcatgatcttgtggaagaccacgtcagcgttatgcttctcctggcgttccagataggtaagccccaggccaaaggccgcccggacatgttcttcgtccagttgcagcacgcccttgtattcgaattcggcggcgaaaagctcctggcgttcccgatggccgtcggccgcgctgaccgcctcctccagccggcgcatgaccggaacgaccttgttgaggtagaccgagggttcgggctggtactgggtgaaaagctgttcccggctgatggctcgccggggtccagtgggaatgaagtcgcggcttaaacgctgcatgagcacctggtccgaatcggccggctgctcggcgtagaaaaaaagccgctgcccggcccgattgatgccgccgatgccgagaaacttctgggattcaatggaaaacacgcccttgacgggcttgtggcccgaccggggcctggcttgcgaagaagggggctgttgcatagggtttttctttggttctcgccaatccatagccggcctgagggcctttcggcaagcgtcgcggcccgagacccaaagtcgccgagttgacagttttttttccccgcgcgtatagcctgtgatgccggcgcgaagccgctagggccgagccgccctggcgacggcgtttggcgggaccaaccatgcatatagacgaataccccatactggtggaacaactgtgtcctgggcttttcatccgcatcgacgagcccggactggcccacccctttccgcccaaaggcttcaagctgcgcaccgacgccgatgtggccaaggtcatggccctggggctggcccatgtctactgcatccccgacaaatccgaccgcctgcccatctctttggaagaactcgacggcttggccggcaaacgccagaaaggcccctggaccgccgcccgcaccccggtctcggccgaactctccagcctcaagcgcgaaaccatcgaacgcaacaaggatcgcctcgaacgcttcgccgcctgcgagaagcgctacgaaaaggccatggacaaggtggtcgaggcgcttaaaaaggtcagctcccccaacgccgaggtcctggaagcggccggcgaagtggttggccccatggccgagacgtttctttcggaccttgatgtgctcataaacgtcatgacggccaaaatgcgcgacgaggccaagcactaccatgccctcaacgtggccgtgctttccatgatgctggccaaggaaatggggttggacaaagcggccatcgaggaagtgggcatcggttcgcttttccacgatgtgggcaagggacgcatccccatccagcggttttccaagggcaacatgatcaccatgaacaaggtgctcaaggaatactacatggagcacccgaaaatcggggccaagatgctggccgccgtgcccgggtttccgccttccgcccagatgctggtgctccagcaccacgaacttctcgacggcacgggctttccggccaggcttcagggagcggccgtggcgctcggggcgcgcatcgccgccgtggccaatgtttatgaccggttgtgcaattccaaggacggcacgcccgtccgcacgccccacgaggccatgaaggccctctacaaaaagcgcggccccctggaccccaaggccgtgaccatgttcatccgcaagctcggcgtctatccgccgggttccctggtcgagttgtccaacaccatgcagggcatggtggtctcggccaacatccgcgattccctgcgcccaagcgtcaaggtctaccaccccgacattcccaagcgcgaggcgctgatcatcgatctgaccatcgaaaccgaactgaccgtggtcaaggcgctgcgtcccgaagacctcgctccggacgtgctgcagtatttaaaccccggcaagcaggtttccttctatgtggacgccgcgccccgggcctaggccgcctttttcccgccagcggagccgctcgtgagccggccgggctcgccggcccgggccatcatgcggaccctgcgcacgggcctgtcccagccgccgggttccgacctcggcgcgctgttgcccctggcccggcaggccctggcctttatcgaccggggcggcgtggacgatccggccaccgccgccgaagcctccgaggtggcctttctcctggcggcgctgctcgacgccggggacgagaatttcgccagacaggcctttcccctgctctttcgcctgggcgtcgagggcgaggtgctggccgtgacccacctggaaaccctgcccgaggaactggccgtctccctgctctcgggccttcgcgacgaggaaaagctccttttcgccaacgcctttttccgccgcccccgggccgatcgccccaagaccgccgccctgtgcctggaagtcctcgaggacgtggtggagcgcatccccgacgagttgctcatcctgcttgacctcctggccaaccgccacgaatacccggccctgcccctgcgaaacgcgctcatccggggacggctgggcatgtggctcgcccggctgctgcaaatggacctttcggccgagcagatacgctatatggctcgggtgtccggccggctgcgcgagccggggctggtggaaaaactcgcggcgcgccttggcgacctcgacgaagtctcggccgagatcatttgccgcgccctggccgaaacgcccggccttgatccggcggtcgtgtccgccccggcccgggccttggtcgacaccccggaagcttcgctcaccgccgccgccctgtgcgccctggcccggtgcgacgaaggccaagcggcccagtccctggccgccctggccgccgccgcgcccggacgcgtggccgaactggccccgtgcctggccggattatcccacgccgcttacaaccaggcggtgcgcgccctgccgccccagggccgccgggccatggtctgcgccgtgtacgccgtgctggccgccgccctgcccgggccggtccaggccgccgcccggggactggccaaggccggcgcgaccgaccaggtgcttgtcgatgtcctggccgccgatctggccgcccgcgcccgggccgccgcccgccctctcccaggccgcgcgcccctgcccgggccggccacggccgccggccaatccggcaaaggcctctggagccgcgtcaaaaccctggttgcccagccgtccgggacttccggcgaaccggccgacaacctgcgccgggaactggccacgccaggcgcgcgcctggaaaaacgccagatcatgtggactgccctggacggcgcggtcctggccgacgtcgaagtggcccggtgttcgctcaaagccgtcagcctcatgggcgcggccatgaccggaaccgtttttagcgccagtcagttcgcggacgtcaatttcgaaggcgcgcgcctggaaaacgtgacctttgacggctgccgcttcctcaactgccggttctccgaagccgtgttgcgcaaggtgcgctttatcgactgcgacatgcggctttgcgcctttggcggactggctggcgaggatgtggccatgacgggcctggacgccctggcctgcgatttcatcggcgcgaccttgaccgggttgaccctgacccgttgccggctgcgggctgtcagcctggtacgggcggtggtccacgactgcgcctgccaaggcgcggttttttccgactgcctgttcgagatggcggcgtttgtccgcatccgttttgtcagtgtacgcaccgaaggttgttatttcgccaaatcgcgcttcattggccccaccgacgaacccgacatcctgggcgcggtggcccgagacgaagcttcggccatcctcgaagcggccgaggccggacagacactgccctcggccctggccgacggcccggggctgcgtctgattgcggcggtgtgcgacatcgtgctggccggccgggactaccgccgccgccgcctggccatgctcgccaacaacaaacgccgcctggcctgggccagacggcggctcggcgaggacggggcggccttcctggaaatgctgccggccctggtccaggcgccgctggtgcgcgacgacaacggcctgcgcccggccccggcggcccgcatcgccgggcaggtccccaacctcgccaccgcccgcctgactgccgctcatttcggcgaccgcgccacagaagcagccaccctccccgacgacgccatccgaatcgaggccgtttataccattggcagcgtcggcaccgtggcccagaccgacgactccgatcttgacgtctgggtcgtcctggccgaggccgacgccacccgcccggatttgcccgcctttcaggacaagctcgacgccgtcagccgccaagccgaccgcgaccacaatctcgaaatccactttttcctcatgagtgtgtccgacatccgcgacaacatcttcggctactccgccgacgagggctatggatcggcccagggctgcctgctcaaggaggaattctaccgtacggccctggtggtggccggcaagaagccggcttggtggtgcctgccgccggacatcgccgaggaaggctacgccaaggccatggccgcccttggccgcaccgccgccgatgtggccgccgactgcctggacttcggctgtgtgcgggccatcgccggagacgaatactttggcgcgtcgctgtggatgatcgtcaaatcgttaacgagcccgttcaaatccatcatcaagtttggcttgctggagaagtatgccgcccaccccggccggccgagccttttgtgcgaaaccctcaaggcctccatcctggccaaccagggcgggctgtggcgctgcgatccctatgccttgctgtttaaggaagtcagccgccactacgaggaaagcggccaagccggggccatggagctgctgcgccaggcctttttgcaaaagaccggcttcgacccctgcgacgaatacgccagccgcaccggcgaggccatcctcgaccacttctttccctacgccccgccggcgaccggctcctgcccgcccctgcccaagaaggccggggccgaggccgagaccggctttgcccagggcatggtcctttgcgacgccatttccaattatttcctcaaggcctacgaacgcctcaagaacagaagcgccgaacttggcgcggccggcggactgaccgaacgcgaccaggccatgctgtcgcggcgcatcgcggccagcttcgccaaacgggtgggcaaggtcatgcggctgccgtttttgcggccgggacggcatctcttcgattcgctggagataggactggaagacggcaaggggcgcgaagcggggctggtggtcaggggagagccggccgtgcgcggcggcgcgcgcaaatcccggcaaaaggagaccttgcgccaggaactttctgtggtgcggctggccgcttggcttgtggccaacgaactctaccggccgggcctgcatgtccaggcgacgctgctgccggccccgctcaccctacccgactgcgtggggctcctgtccgctgtccatgacctgttcccggcccgggcgaccttcaacccgcccctgtcctgggggctgtcgccggagaaggtcacggccgccctgctggtggtcaacatgacggccccgcgcgaagaacgcgcgacggtaagcatcgacactctctacgccacgagctggggggagtttttccacctggagcggaccacgggcctggaatcccttggcatctcgccccgggattatctcatcgactccatggggctgaccctcgaccccgatgcccgcatcaaggttttcgctccggccaagtcgctgtgccaggccgtgcggcgggccaagcggggctaacaccccgcgtcgcggcgtcaaggccgaagccttccacctcaagcatcacttcaacattctccggtaatccccacgtagccaggacaaccaataaacgggcgcagcccaaagccccgcccgttgtccgaatcgcttccccggctccgtcgtggaccggaaaggcgggctaggcccgggcgctttcctcggcagggtcttccagtgaaaccggcggcgtgacgtacagttggttgccgtcgaaacgatgcatggcccggaaggacatccagtaaaacgactgcttgacgacatggcggttgcccacccaatccagcagcagatggccggtcacgccgatggtcagccccacgccccagggcgcggcgatgccgaaaccgaccagcagccacaggaaaatgacgaactcgaaggagtgcagcaccagataaagcctgggcagccgcccttcctcgcagttggcgaagaaatccttcatgccgccccagcgttttttgtagagcaggtagtccaacacgtggtcgcagtcgataagcacgctcgacaaaccggccatgaccgcgccggaaaaacggccgcccgaggcggcgtagccggccagggccaggggaacggcggaaagacaatgctgagcaagtttcataagacgtcgatccttttggcggcctgccgaccggcttcggtgagccgtccgcagtaggccgaaatgtcgtattcgtagtatccggctgcaaagagccggcgcagcagcttccaggccatccccggcccgtagcccagccccagggccgtctcgccggacagcacccggccgggaaagggcgcgtccggctcggccgccagggcggccaaaagccggcgggcgtcggcgtcgagggcgtcaggtacgccggggacgccagtgggcattatacctattataaaacataacgacagttatgttttataaatatacaatctatcaacacctcatttgtcatgtagcttcactttagcaatagcattggaattacacgccggcggcggcaaaagccgcgtccacgatctccttggcctcggcttggagggccttgaggtggtcgcgcccccggaagctttcggcgtagattttatagacgtcctcggtgcccgacggtcgggccgcgaaccagccgttttccgtcaccaccttcagcccgccgatggccgcgccgttgcccggggcgttggtcagcttggccgttatcacttcgccggccagggacgaagccgccaccagctcgggcgagagcttggacagggccgctttctgcgccttggtggccggggcgtccatgcgctcgtagatgggctcgccgtagcgcttggccagctcggcgtagtgctcggccgggtccttgccggtcttggccgtgatctcggcggcgagcagatccatgatgatgccgtccttgtccgtggtccagaccgtgccgtcaaagcgcagataggccgcgccggcgctctcctcgccgccaaagccgaaggagccgtcgaccagacccggcacgaaccacttgaaccccaccggcacctcgcacagcctgcggccaagccccgccgccacccggtcgatcatggcgctggacaccacggtcttgcccacggccgcgtcggcgcgccagcccgtgcgcgaggcgaaaaggtagctgatggccacggccagatagttgttgggatttaacaaccccgcccccttggtcacgatgccgtggcggtcgtagtccgggtcgttgccaaaggcgatgtcgtaggacgctttatgctcaatgagccgggccatggcgtagggcgaggagcagtccatgcggatcttgccgtccttgtccacggtcatgaacgaaaaggtcgggtccaccacgtcgcttataagcgacaggttgaggccatagcgctcggccatgggctcccagtaggccacgcccgagccgcccaggggatcgacgcccaggcgcagcccggcttcgcggatggcggccatgtcgcagatgttggccagatcggccacatagggcgcgatatagtcgtactgctcggtggtctcggcggccagggccgaagccagggtcatgcgccgcacgccggccagcttcttttcgaggtagacgttggcggcgtcctgcacggccttggtgatgtcggtgtcggccgggccgcccgagggcggattgtacttgaagccgccgtcttccggcgggttgtgggacggcgtgatgacgatgccgtcggccaacacgccctggtgatggcgattgaaggtcaagatagcgtgggagatgaccggggtcggggtgtagccccggccggcctggacgcgcacggtgacgccgttggcggccagcacttccagggcggtgatccaggccggctcggacagggcatgggtgtccatgccgagatagagcgggccggtgatcttttgggcggcccggtggtcgcatatggcctgggtcgtggccaggatgtggtcttcgttgaaggaaccgttgaacgatgtgccccgatggcccgaggtgccaaaggcgacgcggcacaagggatcggtcggatcgggcttgacggcataataggcggcgaccaggcgcggcacgttgacgagaagcgaacgcggcgccggcttgccggcgaggggactgacggccatgggggttcctccttggggcgtggcccgagcatggtgcccgaagacggcgttttggtccacagcgggcgacgattggatggaaaatcggggcggttcgaggcgcgtcgcgcgattagaggcagtacttccagacgtcctggaccgtggcgtagcccataaggccaatgagcgccagccagccgcccacggccacggggatgtacaggcgcgaaagccccgaccacaggcgggccagggtgtcgaagaccatcttgccgccgtccaggggcggcagcggcaacaaattgaatacggccagggaaagcgacaggtgggcggccaggatgccgtaacgcgtgagatcgccgccggcgaaacgcgagccctcggccacgatgccgaccacgccgcttaattggtcgggtcgggaaaacagcgttcccaggccggccaccatgccggccagggtcttccagcacagggccaggggcttgacggccagggcggcccagccaagggaaccgggcgcggccagggtcaggacggcatagacggccagggcgaacaggatattggccagggggccggccagggagaagaccagccgtttgcccaggggcagggccagataggccgcctcgtcgcgaagatccggcaggacgtagccgccaaaggggacggcgctgaggcaatagcgcacgccgcccacggtgcggctagcgagaaccggcccgatgcccagggaaaaccgggccaccgggatgccgaccagccgggcggccaggaaatggccgagttcatgaataaaaacgagcaggcccaacaacgccgcgacaacgacataggtcatgggaggcccccgacgcgcttggcgtcagatgaaatccgggtcgatggccgccttgccgccggccatggcgatcttgacgtagcgcaccgaacgctcgtccacgggcacgatgggaaaccggccccggcaggcgtcgcaggcgatcatggccggcttgaccggagccaccaccggcacctcgcgccggcaaaacgggcagggatagagaaacaccagctccacaccgacaggcttggccggggtcagcggtttgcgcgattcgctgctcatgcgccctccccggcgatcagacattgtccggtcatggcctcgggcacgggcagtccagccagatgcaaaatggtcggcgcgatgtcgccgagcttgcccggcgagagcgtcacgcccttgcacgccggatcaaccagaatgagccgcacgggattcagcgtgtgggcggtcatggggccgcctgtgggcgcgatcatttcctcggcgttgccgtggtcggcggtgacgagcacccgccagccggcggccgtggtcgccgcgatgatgcgggccacgcaggcgtccaccgtgcgcacggccgccttggccgcttccaggatgccggtgtgccccaccatgtcgcagttggcaaggttgaccacggacaggctgtggcccttgtccatggaggccaaaaaggcgtcggtgacggcggcggcgctcatctcgggcttgaggtcgtaggtggccacgtcccggggcgaaggcacgagcaggcgctcctcgccggggaaaggctcctcgcggccgcagttgaagaaataggtgacgtgggcgtatttctccgtttcggccagccgcagctgggtcagcccggcccgggaatagacctcgcccaggacgtcggtgacggccaccggcgcaaaggccgccggcaggccgaacgagccgtcgtactcggtcatggtggcgtagcccgacagcgcgggcacccggcaccgggggaaggcgtcgaaatcggcaaaggccagggccttggtgatttcgcgcgcccggtcagcccggaaattgaagaaaaacacggcatcgccgtcgcggatgaccccctcgcctccggccaggacgcgcggcttgatgaattcgtcggtctccccggcggcgtaggcggccttgaccgccgcgaccgggtcggtaaacggctcgcctatcccctcggtcagggcggcgtaggcttgcgccacccgttcccaacggttgtcgcggtccatggcgtagaaacggccgatgagcgaggcgatgcgtccggcccccaggctgtccaggcaggcctgcaagtcggccacgtagccggccccgctttcggggggcgtgtcgcggccgtcgagcagggcgtgaaaaaaaatgtcgcgctgccccagggccgcgaaggcggcggccagggccttggcgtggctgatgtggctgtgcaccccgccgtcggagataagccccatgaggtggacgcgcccgccgccggcaatcgaggcccgggccagttcggccaggaccggattggcggcgagcgacccgtcttccacggccatgtcgatgcgggtcatgtcctgataaaccacccgcccggccccgatgttcatgtggccgacctcggagttgcccatgaacccggacggcaagcccacggcccggccggaacaggccagggtcgtggacggattgtcgaccaagaggcgatccagggcgggcgtgccggcctcggtcacggcattgccgggaccggccggggcaatgccccagccgtcgaggatcaagagcagggtgggcgtaggcttcatgcgtcgctctcgggatcgtcgtcttcgtcatcggcggtatcggcggcgtcggctgtgccgggggccgcggccttggccgccggggccagacgcagggcaatgggcttgccctcggaccacaggccttcgagattgtagaaggaacgctggtcgcccatgaagatgttgaccaggacgtcgttgaggtcgagcagcacccactggccgaggcggtagccttcctggccgaggtaggaatagccgaactcgccgcagcgggccaggacatggtcggccagggcctgggcctgccgggcgctgccggccgaggccatgaccatggcctcgcagatggggctcaggcctgtaacgtctaccgcctgtatttctttggctttcttttcgtagagccaggcagcgacctgggcggccttggcggcgggagcgatgttggcatcagcggatttgacggacattggttctccagaaaaatgactgaagcccgccgtggcgggcaacccctactccttatgcgatttgccgccggcccgcaaatggagcgtccggctttttcccggccctctcttgacgcggcctgccgctttcggcaggaatcccttttggatgcgctgacgacgccatttggaggacgcccatgatttttgacatggataccgaaaccctgccccgcgaggaactcgaagccttgcaactcaaacggttgcaaagcctgtgcgagcgggtctacgccaacgtggccttctaccgccgggcctttgacgaggcgggcatcaagccgggcgacgtgaaaagcctggccgacctgcgctacctgccgtttaccgaaaagcaggacatgcgcaaccactatcccttcgggctttttgcggtgcccaaggacaacgtggtgcgtatccacgcctcctcgggcaccaccggccgggccaccgtcgtcggctacacccagcgcgacgtgaacaactgggccaccatgatggcccgttcgttcatggccgccggggcctcgcgccgcgacatcatccacgtggcctacggctatggtcttttcaccggcggactcggcgcccactacggcgccgaacgcctgggcgccaccaccatccccatgtccggcggcagcacccgccgtcaggtcatgctgctgcgcgacttcggggccacggtcctttgctgcacgccctcctacagcttggtgctctacgaagcagctctggaatccggcatcgatttcaaggagctgcccctgcgcgtgggcgtgttcggagccgagccctggaccgacgagatgcgccgtgacatcgaacagaaaatgggcatcaaggccatcgacatctacggtctgtccgagatcatggggccgggcgtgggcatcgagtgcatcgaggcccaaaacggggcccacctccaggaagaccatttcctgtgcgaggtcatcgaccccgtgaccaaggagccggtgggcccgggcgaggccggcgaactggtcatcaccacgctgaccaaggaagcccagccgctcatccgctaccgcacccgcgacatcacccggctggtcaagaccccctgcaagtgcggccgcacttttgcccgaatgcagcgcgtccagggccgcagcgacgacatgctcatcattcgcggggtcaacgtgttcccctcccagatcgagagcatcctgctcgaaaccgagggtctcaccccgcactaccagctcgtggtgcgccgtgagggcaatcttgatacgctctccgtacaggtcgaggtcgacgagaaaatcttctccgacgagatcaagggcctgcagcgcctggaaaacaagatccagaagaacatcaaggaattcctgggtgtgaccacccaggtcaagctggtcgagccgcggggcatccagcgctccgaaggcaaggccaagcgcatcctcgacctgcgaaacgagggcaagtagcgaccggcgacattcgggcggcaggacacgctacgccgccagggcgaccttgccgcctgtaggattgaccgcccgtcgaggacacgacacgaataagggcaaaggcccgtcatccggagggaaccatcgccatgaaagccgaacagatttccattttcctggagaaccgggccggccgcctggaagaagtgacccgggtcctggccgaggccggcatcagcatccgcgccctgtccctggccgacacctcggacttcggcatcctgcgcctcatcgtcagcgaccacgagaaagccaaggtcgcgctcaaggaaaacggcttcaccgtgggcagaaacgccgtggtggccgtggaggtttcggacaagcccggcggcctgcacgccatcctgagccttttgtgctcgggcggggtcaacgtggaatacatgtacgccttcgtgcaccagtgcgagcgttcggcggtcatcatcttccgtttcgatcgcaccgaccaggccattgagcttttgcagaaaaacaacatcaccatcatccccggcgaaaagctctacagcatctaaccgccgcaattgcaggcaaaagcgccgcttcccgtcggaagtggcgctttttattcgcctgaaccacaacgcccccctggcaagccgtccgcccggaccctgcccgcttccaacacgccttgacaaaaacccgtgcccatgtcctacactcggttacttgcggccgtcgcgccgacaccggcccggccaaggacgatttcatggcacgcctgatccccaaagacgccttcacctgggaactcccccaaaccggaaccatgcgggtcccggccgttttttacggcgacaaggcggcggccaaggccctggaggccgatgtcctcagacagctcgccaatgtcgccagcctgcccggcgtggtcggaccggtggtcgccctgcccgacgcccatcccggcttcggttttcccatcggctgcgtggccgccttcgatcccgaggccggcggcgtgatctccgccggcggtgtgggcttcgacatcgcctgcggggtgcgcaccctgctgaccgatctctcggtggaggacatcgccccggcgcgcgaccggatcgccgacgcgcttttcgcccgggtgccctgcggcgtgggccaaggcggcgcgctgcgtctttccgacaaggacatggaccggatgctgcgccacggcgcggcctgggccgttggccagggctacggcgaggcggccgacttggcccactgtgaggaaggcgggaccatggccggggccgacccggggcaagtttcggccacggccaaggaacgccaacgcgacgagctcggcagcctgggctcgggcaaccattatcttgaagtgcagtgggtggaagacattctcgaccgggcctcggccgacgcctatggcctgcgcccgggccaggttgtggtctcgatccactgcggttcccggggcctggggcatcaggtggcgaccgaccacatggccgccatgcgccgggccgcgcccggccacgacatcgtcctgcccgacccggacctggcctgcgccccggtggcctcggccgagggccaagcctatctcggggccatgcgcgccgccgtcaactgcgccctggccggccggcaggtcatcacccacctcgtacgcgaggtttttgcaggactgtttcccggctgtcggctgccgcttctattcgacgtctcccacaacacctgcaaggccgagcgccacggcgcaggcggccggccccgcacgctgtacgtccaccgcaagggcgcgacccgggcctacggtacgggccatcccgacttgcccgatttctgccgcgacgtcggccagccggtcatcatcggcggcagcatgggcacggcctcctacgtgctggccgggggaaccgaggcggcggcgttgtccttcgcctcggcctgtcacggagccggccgggccatggggcgcaaacaggccgccaaaagcttcccgtcccgggaggtgctggccgagcttgaccacattggcgtggcccttcgggccaagagcctgcgaggggttggcgaggaggctccgggagcctacaaggatatagactcggcggccgccgccgcccaggccctgggccttgccgtcataaccgccaggcttcgtcccctggcctgcatcaaggggtgaccgtcgtcatgctcgaaagccttatccgcgaaaccgacgccctggaaaccctcaccggcgacgccttgctgctggtggaccgcgacggcatcattttgcacgccacggccctggcctcgtgtttttacggtctgccggccccccagctcaccggcctccccctgggcctggccctcaatgactcggcagcccgggaaatctgcctgcccgccaccggccggccggccctggtgcgctgggaacccctgcccggccacggccattccctgcgccgggtgttgctgcgcgacctcacgccccttcgcgccgccaagaccaagctggaggaagcccgcgaggcagccaaggccggagagcgggccaagagccatttcctggccaacatcacccacgagattcgtacgcccatgatcggcatcctgggcatgaccgagctggccatggccacggaactctcgcccaagcagcgggaatatctggagatggcccgccattcggcccagtcgcttttaaccgtcctcaacgacatcgtggactatgcccgcattgagaccggggccttcgaactggcccgcacgcctttttccctgcgcgagaccgtggaagaggtcatcagcgtctttcgccccctggccgccaagaagggcttgtcgctgacctaccgctgcatcggggccgtgccccagaccctggttggcgaccccagccggctgcgccaggtgctcatcaacctcgttggcaacgcggtcaaattcaccgacgccggcagcgtggtcctggccgtggcccgcatcgggggcggccaggccaacgatcagacccggctgcgcttcgaggtgcgcgacaccggcatcggcatccccggggacaagatcaaggcgattttcgacagcttcacccaggccgacgtgtcgcccgcccgccgctaccagggggcggggctggggctggccattgtgcgccagctcgtggaaatgatgcagggttcctacaacgtcgccagcgaggaaggcaaagggagcgttttcaccatcgaggccgatttcagcctgcccgtcagcctggaatccctgcgcccggcccgggaaccggccgcgccggccaaggcccggccgctgaccgtccttttggccgaggacaatcccatcaatcagatttacgtgcaggaactgctggaaatggacggccatgaggtggtggtggcccacaccggccggcgggcgttggaggcgctgcgcaagaaacgcttcgacgccgtgctcatggacatccagatgcccgagatggacggcatcgaggccacccgggccatcaggagcgatgcaagcggcgacttcgatccggccatccccatcgtggctctgaccgcccatgccctcaagggcgaccgggagacgtttctgcgagccggcatgaacgaatacctgagcaagcccgtcagccccgccgacctggaagcggcccttggccgggtcaccgggggcgcgcccgcatccgaacagccccaggacgcctcggccgaaccggccggccagatcctcgactggaccgagcttctcgccaaagcccgaggcaacaccggttttctcatgaagcttttcggggccttcgtggccgaacaacccggcaatctggccgccatgcaaaacgccctggacgaaaaagacttgccccatctggccttcctggcccattcgctcaagggtgcggcggccaccatgtgcgccccggccctgcgcgacgccagccacgacctggaacgggcggcccgggccgacgaccagccctgggccgcccgggccctggacgccctggcccggaacctggacacggtgctggccgccatgcgcgccaagctttcggcggagtaaaaaggccggacagtccgcctcgaacaacgtcggaaagaccatgacggccgaccggaccaatggcggataccggcggcccggccgactcaggtgatgccggcgacgtcaggttatttgctgcaccacagcttgaccaggcgggccatttcctcggcttcgatgcagggcgcgccgtagcggccggcggcttcgagctggcggaagccctcataaaggatgacggccgcggccacggacacgtttaggctttgcaccatgcccatcatggggatatagagcgctccgtccacgtggggggccagatcctcgtccaccccgctgtgctcgttgcccagaataatggccgttttcgtggtgagatcccacttctgcaagggcacggccgtttcggtgaagctcgtggccacaagccgaaagccttggcccttgagcgccgcggccaaggaagcggcgtccttgtggcgcacggtctccacccattttttggccgaacccgaggacttcttgcccaaggccggaaaggccgtgtcggtgtagagcagatgcacccggtggatgccgaacgcgtcgcagcttcgaaggatcgccgacacgttgtggggatcgtgaatgttgttgatgaccagggtcagatcggtctgacgtctggacaggacttcctcaatgcgcctaacccggcgctcggtgatgcagtcgcgcatggccgaggcacataggccaatccgggtccgggcgcaagaaccaaggagttttgccatgccgcgcaccaccgcccccgatgtcgccgccgccaagggcgttcgcaaaatcgtcatgctggccgcctatgatttcacttcggcccggctggccgaagcggccggagtggacgtgattctcgtgggcgattccctagccatggtggtccttggccacgacgacacactctcggtcaccatggaggagatgctccaccatgtccgggccgtggcccgaggggccgggaccgccctggtggtggcggatatgccctttatgtcgtaccaagcgtctgtggagatggccgtgaccaatgccgggcgctttctcaaggaaggccgggccggcgcggtcaaggtcgagggtggacgcgccatcgtgccccaggtgcgggccatggtcgccgccggcattccggtgcttgggcatgtgggcctgaccccacagcatgtggcggcccttggcggattcaaggtccagtccaagacggccgaggccgctgcggagttggtcgccgacgcggcggccctggccgaggccgggtgtttcgccgtggtgctggagtgcatccccgcgcccgtggccgccgccgtgacccggacagtgcccatccccaccattggcatcggcgctgggccggactgcgacggccaagtgctggtcttccacgacgtgttgggactctacgaccggatgcgcccgcgtttcgtcaagcaattcggcgaattgggcaaacaggccgtgacggcgttgacgggctacgccgaggcggttagaaattcagattttccgggggcggaacacagtttttccatggcgtccgaagcccagaccgctttcgaagcccttctcacgccgggtgggggcgaaaaagacgggcacagagcctgatccagccttccttttttgtggcgcaacgcgtccacttttttatgagcaatgcatgaaaaacaagcagtatgacgatgacgtacgagaatttatcgccctgcaaaacggcgtgtttctcgtcgtcagcaccgatgccgtcttcaacaagaatctgcgcagcaccctgcttcgccatctcaccatcaaggacgagtgcgtccacaacattgccgtcaccgaacaaatccccaagcacatcaagcaactgcgtgccaaaaaccacaaaatcgtcgtcttcatcgaacgcgaattaaacggccgcaacacgtccgacgtcatccgctacctgaaaaacgatttttccagcgacctctatgtcgtggtgctgaccaccgaggtcgagcgcgacaagctcgtcctgctccacgaactcggcgcggacaacatcatcaccaagcccatttcggccgatacgctcattgaaaagatcgctttcacggtcaagccccggggacagatcggcgaactcatggaccagggccggcaatgcctggaaatgggcgacgccctggaagcggccaagatcgccaagcaggtgcttgaagccaaggccaacagcccttcgggcctgctcctcatgggcgacgcgttgcgggcgctgggcaaaaaggacgaggcccttcgggcctacacccaggccgaaaaaggtgcgcgcctgtttcttgatcccctcaaaaaaatcgccgaactccaccacgagcaaggcaataccaccgaggaactcaagttcctggaacgtctggacaagctctcgccgcttaacgtcgaacgcaaggtcgacatcggcgcgggctacgtcaagctcggggaacctgaaaaagccaaggcggcattcgacatggccgtgcgcatcgccaccaaggaagccctggacgccgtcagccgggtcacccagtccatcgccgcccgttgcatggagtccgctcccgaactgtccgagcagtacctgcgacaatcgctcaatacccgcaagaacatgctcgaccgctcggacatcgagaccttcaaccgactagggctgatgctgcgccgccagggcaagtggcaggaagccatcacggaataccgcaaggccctcaagatttcccctgatgatcctgggctttattacaacatctccatggcctacaccgagggccgccagtacattgaagcctaccagttcctggaccgggccttgtcgctcaatccggaactgtggaaaaacggcgaggccgtgtgctacaacatcgccaccgtctaccgccgctacggcaagaaagacccggccgtcgattatctgaaaaaagccttggaacttaatccgggctacgaaaaagccaaggccctgctgttggaaatgggagccgggcgctaaagacggccgttttgtctcccccggcggccccttgagcgagattgccgcccgaaagccacgtccacgccgcttgacgccgtaagcgtcaacatcgcgcccctgaaacagcctaacatcctctccgcgccagccccaagcccggccggcgactcgcataaccggagccatccccatgttcgtgcatccccagttcgatcccgtggccgtcagcctcggccccttgtccatccgctggtacggcctcatgtacttgatcggcttcgccgcggcctggctgctcgggcgctatcgggcctcgcgcccgggttcgggctggacgccgctgcaggtcgacgatctcgtcacctacatggtccttggcgtggtcgtcggcggccggctgggctacatgctgttttacgatctgccggcctttctggccaatcccctgagcctggtccaggtctggcaaggggggatgtcctttcacggcggctttctcggcgtgctggcggtggtgtggttttttggacgaaaaaccggcaagggcttctggggcgtggccgactttaccgctcccttggctccgttcggactttttgccggccgtatcggcaacttcatcaacggcgagctgtggggcaaagccactgacctgccctggggcgtggtgttccccgatcctcgggccggcggcgtgccgcgccatccctcccagctctacgaagcgctgctcgaaggcgcggcgctgtttctcatcgtctggctctattccagcaaaaagcgccaatccggcgcggtcagcggcgtgttttgcgtctgctacggcctgttccgcttcgccgtggagttggtgcgcctgcccgatccccaactcggctacctggcctttggctggctgaccatggggcagcttctcagccttccggtcatcgttttcgggctgtggctcctcgcccgtcgggccccggaccaaaacgcctcacagtaacccgacaagcacttccagtgggaaaacctgccggggcctgagccggcgcgacgccgcaggcgcttttcgccaatgcaacgccagaccccgcccggacggattgcaccctattccttgtgcaggggaataagcaaaaagtccccgcacagatcctcggcctgggtttccggccacatggccacatagctcttgccccgggcctgctccaccggcacggtggccggcgacggcgcatggcgcttgcaatagccccactccccgccctgcatctcctcgggcggacaatagcggtgttcggggggaatcggccccttccagtaccggcacatcctgcacttctgcttcatcctgcctgccttggcatacgccttttcagccatggtcatggttttgctccgccgccaagccccgacaggggagacccgcccgtgggcagtcccggcacggcgatttcatttatttcgggccaacgcttgcccgtgacccagacccggcccgtggccggatcgtgggcgatgccattaagcacgttctcgaaatccacggccaccgtcccaggacgcaatcccgaacaatccacccaggccgcgacctgtcccgtggccgggtcgatgacggcgatacgggtgtcgccccagacgttggcccaaatgcggccggccacggtttccagttcattgagccgggaaacgggccggccatcgtcggtgacggcgaccgatcccagggcggccatggtcttgggatcgtaaaaaaacagctggtccgagccgtcgctgaccacgagccggccatccaggccgcacgcgccccagccttcggtgggcagggccagctcgccccgggacgagagatcggaggggtcggccagaagcacccgcccttcccgccaggtgagttggtacagggaaccgccgctcagggccaggccctcgccgaaaagctcgcgaggcagttcgcgccgggcaaggacctgtcccgtggccggatcgacccggcgcaggctggaacggccgtagagtccggtgctctcgtaaaacacgccgtcgctgtagagaaggccctgggtgaaggcgctcggatcatggggcagccgggccttgaccacgacaggcagcaccggggcagcgtcggacaagaccggcaagaatatgagaaaggccaatatggccgccccgccaagagccagccgtttaataatccaggacatgtttggaatccacaccgtagcggcgcatgcggttgaggatggtgccccggctgacgccaagcaggcgcgcggcctcggaacggttgccgccggcccggcgcagggcgtccaccagctcgtcgcggccggcctcgacgggcgccgccgcccgacagacctcgcgcagggcgtcaggagcggccgctgcgataagcgccggcggcagatgccttggctccaccggcccggcgtcggtgacgacaaaggcgtattccagggcgcttttgagttcgcgcacattgcccggccagggatgggcagccagcaggcgcatggcttcgggagcgatggagggaaccggccggccggcctgatgggccagacggcacaggaagtgttcggccaggggggccagatcgtccaaccggtcgcgcaggggcggcaaggtgatggggatgacattgacccggaagaacaggtcctcccgaaagcgcccctcggccacgagccgggccagatcgcggttggtggccgagatgacgcgcacgtcggcccgcaccggccggctctcgcccacccgctcgaaggtcttggattcgagcacgcgcaacagcttgacctgtatcgacgccggggcgtcgccgatttcgtccagaaaaatgtcgccgccgtcggcggcctcgaaccgaccctgacggtggcgcgtcgcgccggtgaaagcgcccttggcatggccgaagagttcgctttccaggagcgattcggtcagggcggcacagctaaacggcacaaaaggcccccgtcgacgccggccgatctcgtggatggcccgggcggccaattccttgccggtgccggattcgccggtgatgagcaccggcgcgtcgctgccggcggcccgctccagaagatcaaagacccggcgcatggcctcggattcgccgatcaggccgtgaaagccctcctcggccgaaagcaggcgggtgagttcttccaccttgcggtccaggcccacgacctcggaaaggtcggtgagagtctccacggcaaaaagcggtttgcccgcagcatcgcgcagcagcgtctggtttttgagcaccggcagatacgagccgtccttgcgacggatggtgcaatgtttggcccgggtggtcttttcggcaaaaaggcggcaccaagccgcgccgccctggccgcgctcgcgctggcagccgtcgcagtcgagcacgctgcaggcatggcccaggagctcgtcccgggcatagccggtcatccgggacagggcttcgttgatcatgacgatgccgccgtcggccccaaccaggagcaacccctcgctcatggtgttcacgatggctgccaggtgctgctcaaattccacggcggctccgcttgggtcctacgctgggaaaggtgttgggatttaggccgcatcggccactgtttgctcgttatcccaaaccgttagcagatcaggcacgatcatgcaagaaacgtggggaggccaaaacggcgcggcggcccttccgccgccgcgtggcctgtgttatctacgggccatgaacgatatcctgatcttttgcgccgtgctcgtcggctggttcgtggtggtccgcttcgtcttccccaggctcggcatccggggctgaggcatcgacacggggtgcggtccgcgccccggcaagccttcctctgctccaggcgacaaagaggattggcctaaaagctgatcttgaggccgatgttgccgccgacgctgttgacgccgttatcggaaaacgcgcccagatgctggtaacgtccggcagccttgaggctgacgttcttgcccagggccacggacgcgccgaggtcggcctggccggttccggcctgcttggacccgttgtagggcagctccttgtcggagaaaacgccgccgccgcccgcgccgacgaaaagcgtccccttgggcgtgcgcacgaagttccaacgggccatggccgcgacgccggcggcgttggtggtttcctgtctggaggccatgccgagcggcgtcggcgtcttggtagtctgatccacggcgtagcccaggccctcggcctcaatggccacgccgtcggcgacgtaatggccggccgcgccgccgtaggtgccgaccacgttgacgttggggttggtggttgcgtagacgccgccccggggttcgacgtagctcgtcccctgggtatactcctgggctgcggccagggcaggcggggccagcgcggcaaaagccgcgagcagggtggcgatggcacggttcatgtttggctccttgcggcccggcgacccgccgggtttcagtgcatgaacgacttgacggtttggggtttggcctcggtcttggccgcgggcagcttttcgagaatcacggccgtgccgtagcaggaaaaatagcgtgagccgtcaggatggaaggccacgttttcctgatagccgatgatggcgtcggccccgatgtccagggcgctggccgtcaggccatagaaggcgcactcggagtcgaagccccggccgctgaccaggccaaggacccgccggatcttgcggccttcgagcccgggggtggtgaccaccggaaacttgccgctgaaaaagagttccttggcgtttttgagccgcgcgcccttcttgagttcttcgtggcgttcgcggattttcttgtctgagccggtgaagagggaaagcatgccgtcctccttgtcgtcacgttgcggcgggcatttcgcggccgccttcctgtctgttccggctttttcttagcaaagagcctgccaagaaatttatttaattatttcaaagaaaaaaagcgccacctcgcgcgttcgtcaaacctttggcggcaaagtgcgtcgtcgcagcggcggtccatgaatccggcgacgcgcccttgaggcgtctgttcgacgcgcctcgccggcagtcgtaactctcggagagccaggtttttttctggcgtcgttgggaagccccgcagcccgaggcggcggtcagggaacagcacgggactcgggatgggcccatctggttcgacgctgtccctggcggtttcggctgcccgcaggatcgccgggtggcgtacggttttctgggctggtctgatgtcaacgacgtcatgcctcgcatgaccgcagggtcgctgagtggcctacggggagtccttatcgacgcccccggcgctttgccgaggggcaggaagaacgagaccgtttttccgccgctccggtcgggcaaggccggcccttgctcggctcctcgccccgccgtcctcttccttggcaacctgttggaaggctcatggccgccgggccaaatccatttgcgcaaaaaaaagccgggccgcgacgacccggctcatgatgccagagggatgcctcagccggctttgtccagatagcgtcgcacggcgggattgggccgcacggtggtgcggtagcccgaaagccgctggttctcctgcttggccctctgcagatcggtttgaagttcggcgtggaggcgacgggcttccacggtgagctggccttgcaggttgcgaagcttcagcagcttgtcccgaagcaggccaatgctctccggatcggcgcagcgccaggccatctccagcaggcggccgcgatccttggccaaaagttcggcttcttcaatttcgccggccagaagatggtgcagttcgcgttcaccggtggccagggccgcttcaaggaattcaagcttgtcggacatggcgttattccttcacggtgcgctcgaaaccggtcagcagttcgccgatgacgcccttgaaccgggccatggccggaatgaattcgtattccagcagatcggcaagcaaaatccagtcttcgttttccagcacttcgagcatttcggaaaacaggttggacacctcgtcggcgacggcgttgaaggcaggatcggccgttctcagggcctcgccgcgcagcacgccgatcatgttgaggaagtcgcgggtgacgtccatgaggtcctggtagacttccagggcttcggcgtcgtcggcctgacggaacagctcggccacccggcgcgcgccgtggtccatgagctggacgactttgctcatctcccgggtgatttccagggccatgtcggccacgggcatgctgcggacttcgacggattcgatctcgtcgatctcgatgtcctcggcctggtgcgggtagatctcggaaaaactttcattgttgacgaacacatccgtgacgacccggccttcaagctcgttggtctccatgatgcgcagaaggatttcctcaagattgtgaaactgcttgatctccatgccggttgaccggccatccacactgatcatgtcgcgcctccctctggagttgttgtcgaagggtaaggatttccttcccgccccatttcttacaacaaccgtgccaaaaggagtcagccctgaaggatggccgcaaaagccgccgcgcaggcgccgtagcggcgaatgcgcgccacaagcccgtcgatgtccacgacttcctcctgggcttggcgttgccacagttgggccagggtcgccagataaggcgaggccgaccacagggcggccaagcggttgtagctggcaagaaagcgcttcttcatggccggattgcgcatggccagcccggcttggccctcgacgaggcgcagcagatcgacggattgcgacaacagccgcgacaattcctggcgctcgacctcgggcagcggcggcagcggcctggccggcgggacatggggaacatcgtcaaggaattgacgaagaacatgacgctgacaacgcagccacacggcccggggagtggtttcgtggccggagagcgaaacgaggtccatgaacccttcggcgtcccgcgcggacagccaggcccgggctccggaataggctccggccggaaaacgcccgtcccggatccaggcgaggacggcttcggccacggcttcgggatcgatggcgtccagacaggcgtgactgcgggaacaagcctcccgaaacgagcagggatggcacggcatgtccggctccagacacagacagccctccagataagggccggtgtcgaagggttgggcagtggccaaaaacagggccacgctcggcacccccaggccggcggccagatggagcgtgccggtgtcgttggtgaccaagagccccagccgggccaccacagctgccagcgtcggcagcgaggtggctccggacaagtccaggcaggggccatcgaatatctcgcgaaaacagaccgccaggggtttttccgaggctgcgcccacgagcacggccaaaatgccgcgcttttcgtggagccgtgccgccagccgggcaaaacgctccaccggccactgccgggccgccgcgctggccccgagctggaaccccacgaccaacaagtcgtcacaaggcccggccccggcgaaaagcgctgccgcttcctcggccgccgccgcctcaggccggcgcagggcaaaacgtcccggcccctggcccacgcccgcggccttgcggaaaacgtccacgatattaaaaggacacagctcgcgccgggtcgatgacgcctccagaaacgaggcccacaggttggattcgtggcgatagccgaaagggtccagggtaaagccgcgcacggcctcgccgcacagtctccgggccataagcctggccggcagggccgccgtcaggttgaccacgcagtccggccgggcccgggtcgccaccgtatccgcgaagtcggccaccgtcgccagggccagcttccaatcgacatcgaggctggcgagaaatttcgccccgggcaggggaaaaacttccgatacgtcagccagcaacccggccgcgccggcaaaattttccagacaggccaaagaaacacggtcccccccagcggccagttcgctgacggccggctgggattggagcaaatcgccaaagcgggtgaggttttgcaacacgatgttcataccggctccatgacggactttggcgtttcggacaaattgccgcgacggacgcggccgacttgttgccccggcttgaaggtgctaccagcaaagtcaggcagcatggcccggccggccggccccaacacacccatgagcacccccatcgacgataacgccatcgccgccaaggccctggaactggagcgtttccttcccgaaggccgtcgcgacgaatttcgccgtctcatcgagaccctggccgaggccgccgcttgccgggagaaccagaccgccgagatcggagaactgcgcggccaggtccgccgactgggcgcccgggtcgtgcggatgcaggaaatctttcgggccaacgaccaggccttcgccactttccgctcggccatgctcctgtcgcgacggctgcgacgcatggccgatctgcccgacatgctggcggaattgtcccgtaccatgggggtcgcggccctgacctgcctgctttcccgggaacaattcgccgcctacgtgcctccgggattcccctgcccgacggccaaggccctgggcgcggccgtaaacgccctgccccggggaaccgatccccgccgggtctacgtcggccctctggccgccctgccccggccggatttctttttcgatccggccattctggccgatcagcccaaactccgggacggttcgtgctttatcgcgcccttggccgacaagtatcagcccaagcgccgcatcggcgtcctggccatggccgacgtcgatccctcgcgctacacgccgtccaaagggacggattttctggagcatttctgcgaggttttggccggcgatctgctccacgtcaagatccatgaggaattggcccggcagcgcgagtccgacgaactgaccggcatccccaaccgggccttcctgcgccgccacggaccggcgctgttaagcctgtccgcacgccgggaagcaccggtggccctgcttttttgcgacctcgaccggttcaaggccgtcaacgacaccttcggccacgaggccggcgatctggtccttggcgacgtggcccgggccatggccgcccgggtgcgggtctatgacctgctggcccggcttggcggcgacgaattcgtggtggtcatgcccgacgccggcgccgacgaagccgccgtcatggccgaacgcatccgggactgcgtggccgaggtggccgccgagcgcggactgcccgggctgtctgtgtccatcggcgtggccttgcatgccccgggccaggacatcgacgacctcgtacgggcggccgacgccgccatgtaccgggaaaaacgcgctccggccgccggctgacaattcccgggccgtcccggagcaaactgcatcccaggagccttccatggttctttgccgctttttcgtctggctgttgtccattctccttgcttgcgccgcgaccccggtcgaggcctcggccgcgtcccgaaccgcccggctggccggggagatgaccctggaggaaaaagtcggccaggtgttcatggtctggttcgctggcccagccgtttccgacgacatcgccggtctgatccggcagcgccatctcggcggcgtcatcctctacggcgtcccgggcaacatcgaatctccgggccaactggccgccttaaacgccggcctccaggcggtgtccgccgccaccaggcatggcctgggcctgttgatcggcgtggaccaggaaggcgcgcccgtggcccggctgcgaaaaggcttcaccctcttccccagccagatggcccaggccgccactggcagggccgatctggcccgcctggccgcctcggccactgcccgggaattgcgggctgtgggcatcaacgtcaatttcgcgcccgtggccgacgtcaacgtcaatccggctaatccggtcatcggcatccggtcctttggctccgcgccggccgacgtggcccgtttcacgggagcggccacggccggctacggcgccgccggcatgatctgcacgcccaaacatttccccggccacggcgacacgaccatcgattcccacgtcggcctgccgcgctcggaccatgacgccgccgccctggacaagcttgattttccgcccttccgggccgctttcgccgctggcgcgccggcggtcatgaccgcccacatggtcgtcccggccctggacggcgaacccgacctgccggccaccttgtcgcgccgggtcctggaggggacgcttcgcggccgcatgggttttgacggcgtcattttcacggattccctgggcatgggggccgtggccgacacctacggcatccctgaagcctcggtacgggccctggccgccggggccgacgtgctgctcgttggcgcggacgccggccgctcaccaggcgaacgcctggccgccatggacgccgtcgccgaggccgtgcgctcggggcgcgtgcccatggcccggctcaacgccgccgtggggcgtgtccttcgcctcaaggaacgctacggcctgttggacgccgccgccctggccaatcccgttcccgacccggtcagccagatcggccgccccgaagacgccgtgctggcccggcgcatcgccagacgcagcctcacggccgttggcccgacaagccccgccctgcccctgcctgccgagagctgtctggtcatccggccgcgccttggccgcgaggccgtggacgctgaagccgaagcggccatcgccgcctgggccgggccgcgcgcgctctttttaccggccgatcccgatgacgcggccatggccgaggccctcgacaaggcggcccaggccggcaacgtcgtttttttggccacggacctgcgccgccggccggggcaggaacggctggtccgggagttggccgccaaggccggccgcgggttcgtgctggtggcggcccagtcgccctacgatctggccctggtcccgcagtccggggcgcggctagccacctacggcgaagctcctgccagtctggaggcgctttatcagggcttgtttgccccctttcgcttctcgggccgcctgcctgccgttttgccggctacggccctcaaacaacaataaagcaactacatacgtcgtcttaacacctcaaacagcattgacctttcgcctcaaatggtattgtatgaaaacaaattgtaatcaggagcatccatgaacgaccatagcgccacgccgtcgcccggcgcgccaaccctgttgctgggcctggcactcagtgtttgcctcctcgtcgtcgccttcttccccaacttatatattgccattccggtagccgttgttggctgcattgcagccgttgtcctcgcttcacgggtcaacgctcccatacggatgctgtatcaggggttgttgacaatcaacaatgatccaactgcgtttcatcttgacgacgtcaatgcctggaaagcacttggaccgcttggtgaacaggccgcccaggccctttcctgcaacatgttgcggcgcgagtattaccgaggcgcggtcaatgccgtcagcacgccgtttttcatcaccaacaaggacggcatcatcacccattgcagccagagtttgtgcgacatgttgcgcaaatccaaaaatgatgttgtgggaaagaccgtcagccaggccgtctataataaaaccggcatctcgcttacggagaaatgcttaagcgaaggcaaggcgttgcaggccgaacgcgacctgaccctgtgggacggccgcattctgccttgctttttctttgtcgcctgctttcacggcctgcgcggcgacctgctcggtgcggtggccacgatgaccgacctgacgccgctgcgggccaagcaggaagaactggagcacgcccaggccgaactgcgcaaccttggcggcgaaatcaacgaactggcccaacgcgtggcctcggcttccgaagagctgtccgcctcctccgacgaacaggcccggggcgcccaacaacaaaaggggcagtccgacgccgtggccacggctatggaagaaatgacggccacggtcatggaagtggccaaaaacgccgcccagacttccgatgccgccgaaagcgccaacacggctgcggaaaccggctcggtggaagtccgggaagccgtgtccggcattaaggccgtggccgaatcagccggcaagctcggccaggtgctcacttccctggacggccaggctgccgagatcggccgcatcatcagcgtcatcaacgacatcgccgaccagaccaacctgctggcactcaacgccgccatcgaggcggcccgggccggcgacgccggtcgcggcttcgccgtggtcgccgacgaggtgcgaaaactggccgaaaagaccatgaccgccaccaaggaagtggaaaaatccatccgcgaaatccaggacggctcccagcacgccgtggcctccatgcaggagaccgaagcccgggtggcggccagcaccgaggccacccacaaggccggcgaatccctggaacgcatcatggcccgcatccgcgaggtcaacgggcaggtcagccagatcgccacggccgccgaacagcaatccgccgctgccgaagagatcaaccgcaacattgaagtcatcgcccatgtggccgccgaggccgacgaaggcgcgggccagaccgcccaggccacgcgcgaactggccgaactggccaattccctgcttaccctggccacgacctttgcccagcgtcaatcaaacgccgtccacctccgggaatccagcggcaacatgaagggcatcctgcccaagctcatgcaaaaatttatcaaggaccagtacggcgaggctgtctatgaagccatgcaggaagatatgggtcaccccaccttcctgcccacccagaattacccggatcaggtgctgcgccagatggccgaactggcggctcaaaaagccggcaagaccgttaaggacgttttcctggttcttggccgctacaccatcaagggcttccacaagcactacccgcgctacttcaagggcgacaccctcaaggaattctatctgaccatgaatgacacccacgcccggctcaccaaggacatgcccggactcatgcccccccgcttcacctacgaagacaagggcaaccgtctgatcatgacgtatatgtccaagcgcggctacccggaatactacgagggcatcttgcgcggagccgcggagttcttcaaggaatccgtggatatcaccgtgtcatacaacgacccccacacggcccgggccgagatcgtcttccgttcgccgcaaaaaggtcccaaggctcttggagcctaaggcctcaatctggcgcttgcccggtgacccgttccgggcaagcgccccgcgccgccatgccgccctcgcccctcaccatagcctactacggtttcgatgatccctttgccgcctgcgcccggctgcgggtatacgaaccagcccgggccctggggccggccgtacggttgatccccggagtcgccgcccaaggggccggccatgccgtaagtccggccgttatcgaatcggccaacctcatcctcatccagcgttttttccccggaccggccacggcttccctgctcgaggcggccttcgccagcggcaaacccgttgtgtacgacaccgacgacgatttcgaggccacaccgccggaacacgcttttttcccgcacctggccccgcttttgcctttcgtccgcgacaccatcgcccgggcggcctgcgtcacggtgagcacaccggccctggccgccgtgtacgccggtcgcgccagacaggtgcgggtgctgcccaacttcctgcccgacgccctgtggagccttgccgcgccgccaaagcgtccggttgccgccatcggctttgccggcacgccatctcatgccgccgatctggcctgccttgcaccggcctttggcgagcttgcccgacaacccgatttcactggccggttcgtttgctttggctgcccgacgccgccggattttccggccgacgccaccgccatcccctttagcgccgactacgccgcctacgctgcccgtctgccgcgacttggcctgtccattggcctggcacctctggccgacacgccttttaatcgggtcaaaagcgcggtcaaatggcaggaatacaccgccgccggggcagcaagcgtctgcgctgatctgccgccctaccgcgaggtggtggaggatgggcgcaccggactcctagtcggcccggacccgagagattgggcccaggccgtggcccggctggccggggatgccggtttgcgccgccgcctggcccttcaggcccgggaaactcttgaccgcagccatttgctcagcgcccaggccgccgtctacggcgagctctggcgggacattgcccagggaggcccatgatgactccgctctggttggacacacccggtttcccgctaccgctggccgatatgctcctggccggaacccttggccgcgaccacctgctacgggcggccgccatggcccaggcggccggggaaaccgcgcctgacaacgccgactggccgcgccttcgccgccagctgctggccgccgccctggaggaagacccgctttacggcccgacggccggcgccctggcccaggcccttcgcgccgcgcccccgggccggatcaatccggccttctccgctcaggtcgaggccctggctgcccggttcaggccgcccgagagcgtcgcctactatgaacggctcctggccgccagcaacccggggcgtattgaggcctatctggaaaacgagatccgaaacggccgggccgccctgttctggctccacatcgccctgcatcgggccgtccttggccgggatttcgaccgggcggccgccctggccggactggccctggctggagagctgacgcccttggggcacaaggtcgcgggcgacctagccctgcttcgcggcgactccccggccgccctggccgcttacgacgcggccgaggccctggccccctggccggcgggcctgtttcgccgtcccctggctgccctggccgccggccgggaggacgttgccgccaaagccctggctgcgcttcttcgggacttccccgagcacgtctcggccggtctggccttatacgatctgatctcagggcgtcgccgcggcctggggcgcctggccagcgacctgtgcgtggccctttacaccttcaacaaggccgacgatctcgacaaaaccctggccagcctttttgcctcggacttttcccgggtggacgggaccgtgcgcacgctgctgctcgacaacgcctccggcgacgccacgcccgacgtggtcgccgcctggaccgaccgggtcgggatcgaccgtttggccgccatccgggtaccggtcaatgtcggcgcgccggccgcccgcaactggctggccagcgatgatcgtctggccgaggccgcccatgtcgcctacctcgatgatgacgtggatttgcccgtcgattggatcgcccggcttgccgccgccgccgaggcctatcccgaggccggcgtctggggctgccgggtcctggacgccgtcaatccggccattgcccagggagtcgatgtcatgctcctgccccctgatcaggggcaggaggagccgcagctctcgggccttcatgctcaaggatttgatttcggaggctttgcccacttacggccgtgtctcaccgtcatgggctgctgccatctctttcgtcgggagcgattgcttggaaccggcggcttcgacatccgcttcagcccgtcccagtacgacgacgtggaccatgactggcgactggccttggctggcacgccgccagtctatcaggggcatctggccgtagcccaccgccgcccggctccggccctggtccggccgcgcccggaccagttggccggcgggcaagccaactggcaaaaactcgccgccaagcacgccgggcgctacgcagccatggccgccgccctccggcaggcgaccacaagcgatctgcgccgcaaatacgaggtgttggcccaggtcggtcctagacttgacgccggcttttgacggcaggaacggcgacgcgtctggcgctgcgtcccttaacaaatacgatagtatttgttaaaaataatcaatgatagtagcctgttgcccgcgagttgctttgtatgcttttggagggcgcgacactaggcggcgctgtcctcgggggcaaagctcaaacggaaaaaagccccctcgccgctgcttccaaacgacagggtaccccgcaattggcgggtgagctgcaccacgagctgcatccccagggtacgcgtggcatcgggatgaaaccccgggggcaagcccgcgccatcgtcttcgacagtgatatgggccaggacaccatcgcgctccagccgcacccggatggccccggtatcccggctggccagtccgtgcttgaccgcgttggtgagcaactcgttgacgacaagcccaacaggaatggccttgtccacggacacccggcaatcggccaagctgagggcaaagccgacgcttttggctccgcgcaacgcatggaccaccttgggagccagccgctccagatactccttgatgtccacacgggccagatcgcccgaacggtaaagttcctcgtgaataagggccatggaagcgatgcggttgcggctttcttccagcgcgccttgcaaaacagggtcgctcatcgcgtctttttgcaaaaacagcagactcgaaatgatttgcagattgttcttgacccgatgatgcacttccttgagcagcacttccttttcagccagggagtcgcgcaattcccgttccctgattttttccgccgtcatgtcgcggatgacgccgacaatgaagcgctggcctcggtgatcgacaaaaagccccttgcgcgtcagcagtgtgcgcacctgtcccgtggcgtcggtcaggtactcctcgtacaaatcgggttggccggtctccaaaacgatgttgtcgcgctcgacaaagaccgtcgcctgctcgatgggcacgaaatcctcgtcgctcttgccaataagaacctcggccggctgcccaagcatggcgcacagggcctcgttgaccaggacaaaacggtgggcgctgtccttgacgaaaaccggatcgggaatggcttccagaataagcgtgctgaattgcctggaaagttccagttccgtctcggcccgtttgcggtcgctgatgtcgcgcgaaacggcgataaaaccgcggaatgcgccagattggtcgaaaacgcctcgaatcatggactccagccacactatggagccgtcccggcgataggcttcgatttcaagcttgcgcacgaaattgctgtccacgggctttgccgggtccaagtggaaagcctctaggacacgccgggccgaatccggcgtcatgccgacgtccaggggccgggccagggcttcggcaacggaaaaacccagcagccgggtcaccgaggggctcacgtacgtgagccccaggttttcgtcaaaaatattgatgaggtcgtgggcattgtcggccaagagtcgatactggcgctcgctgcggcgcaggctgcgctccgcggccttgcgcggccccacatcccgcatgaagaccaacgcgccgggaccgccgttgacgtcgaagggcacggccgccacttccgcttcgatcatgccgccgtcgaggcggcggtaacgctgttcgcgcagtaaagccggcacgcgctcaataatgttctgccggatgcgttcacggaccgaagcctgaacttctccgtccacgaaatccatgatctcccggccttctatggcctggggcgacggcgcgccaaacagcttggccgcttccgggttggcgtacagaaaccgcacgccgtcgtggataaggatggcgtccggggcgaactccaccaccaaccgatggcgctcctcgctgtctcgcagttcctgttccttgtggcgataggcgtcgtcgtagcggcgtagcaaggtgtaaagcagcaccgaggtcaggcccacaaagaagaaccccttgagggaggatacccgcaacaggatgtccggatcgtgccggaacaaggcgtcggccagattgtccgagccaagaatccagaccagcccaaacagggcgtagaggagtgaaacacgggtcggcatggggccaagccagcgggacaggcggcttgtgggctcgggaatcggcatggatttccgctccgggagccggatcgccggcgcagtggccgtaagggcggtcgacccgttccggttattggttttccgtggccttggtgagccgggtcacgttgcttttggtgaaaaacccgtcaaacccgtcatagcgctcaatgtactcgttgaccagcatggtgcgcggcgacatggctgaaaaaatctgtttgaggccttcctcccgggagccgaccagctccgaaagaaagcccatgccgtcggcgacaaggccggccaccacgtcttcgatgccgtcggccgtaaaggccatgtgatggggccgcaggccgtagttggcgataaacgcctcggtggggccgccgtctcccccgctgtccggagaagcgatgcccgaggtgaacacctgggcgtagtcgccgtcgcgaagccgggccacgttggtgatggaattgagcgattcgacgtagaccgcgaaatcaaagcggtagttggtcagttccagaaactccacgatggccgcgtcgcggtgggcggcccgcacccgcgtggccacgtggtccaggccgccgatgcgggcgagatagggacgcgcggcggcgtccggcccggccggagccaggggcaggaggttggaccggccatggacgtaggctccgggacggccgttccactggataaaccccagggcgttgccggtatgggccgaaggtttggtctcgatgtaggaaaagacgttggtgaccacgggctcgggggtggcgaaggcgactccccggccacgctggatggacacgtaacgggccaggtcggggcagtcgaaaacaaaggtttccagacggccgggggcggctccggcggttttgtggccgccgttgtaggcgacaaagggattgggttggccggccggtcggcttttgagcagaaaatccgcgccttcgagatcgcgcagcaggattgccgggccgccgccagggctcaagggatggtccagggcggcctcgaagcgcaggctcgtgccgccaaggagttcctcggccgccggcacgaggtcggcctcggccacgtttatgaccacggcggccagattaccgaccagcccgtcgaggccgtccttgcgccgacgggtcaaggctctctcgacttcccgcagcaattttgcgtcgtcgttgacaaaagcttccatcggccatggcctccaaggctatcggttcacagcatgtccaccgggtccaggtccagggtacagcgcaccttgtccgccttctccagggttttggccccggcggcgaacacctggcgcaccccgggccaatccggcgatttgatgaggcagtgcaaccgccgccgaccagcgaccagggccaagggcgcgggcgccggccccagcaggcgcgccccgacggcggccgccgaccggcgcattgcctcgccggccgcggcggccagggcgtagccttcctcgtagtcccggggaaaactcaggcgcaccaggcccaggcgcacaaatggcggataacacaaccggcggcggcgggaaagctcctcgtcgaaaaagccctcgtaatcgccacgaaggacataaccaaaaaaaggatcctcgggcatccgggtctggatgagcaccctgcccggccgctcgccccggccggcccggcctgccacctgggtaagcagttgaaaggcccgttccgaggcccggtaatccggcaggttgcggcccaggtcggcgtcagcggcgataaccagggtgacgtccgggaaatgatggcccttggacagcatctgggtgccgaccagcacccgggaacggccggcggcgaaatcggccagcacggcccgggcctcttcgggacgacgggccacgtcgcggtcaaggcgggccacggccgcctcggccggcaacacgccggccagctgttcttcaagcatctccgcgcccacgcccatgggcaaaaagctcgtgccgccgcagcccggacagggcgagggatggggccgggcatggccgcagtagtggcacaccagccgctcccggtccttgtggaaggtgagcgacaggtcacagtgggggcagcgcaccggggtttcgcaatcgaggcagaagagcagcggcgcatagccccggcggttgaggagaatcatggcctggccgccctcggccacggtttgggccagggcggcggcgcttgcgtcggtgagcacgccgacccggtcgccggtttcgcggttaacggccgaacccgtgagcttggccgcgccgcgcatgtccacgatttccacgcgcggcattccgcccccgcccacccggcgctctaaacgcaccatgggcacatggccggactgggcggcatggaacgtcttgacgtccggcgtggccgaccccaggacaaaaagcgccccggattgcctggcccggaaaaaacccacttccttggcctgatagggcagccggtcttcctgcttgaaagccccgtcgtgctcttcgtcgaggacaataagcccaaggtcgcgcagcggcaggagcaaagccgagcgcgtaccggccacgatggccggcggtgacccgccgccgcagcgccagaaaagcgcctcgcgcagggccggcgactggtagccgtggtaaaaagccggcccgacttcgggaaaggcccggcaggctgcccggtggagcttttccgccagggccacttccggggccaaaagcaagacctggcggccccgttccagggtgcggcgcacaagttccatataaaggcgcgtcttgccgctgccggtgaccccgtagaccagccgggccgcgccatcggggctgtccaaggccggcagcaggctgtccatggcggcggcctgttcgtcggtgagcggcggcaaggcaacggcggcggacgtctcggccggctggacctgggccgctgtttcgagctcctcgatgcgcaccagccccagttccgccagccggcgcaccagaggcagggtgcccgggccgagcttagccttaagttcggacagggccatggggccagcgtcgcacagggcgtcgaggaccgccacctgcttggccgcgccgggccgcaccggccagggcggcgaggcggcaagacagcacagcggatcgctctccccggcttccaggcggcaggccatggtcccgtcccgccaggccggggcgagttccaaacgttcatcagaggatttgcgccacaacgcagttgcggtcagagccttgggcaggccggcggcgcggcaggtaaagaccaccttggccgagcgcagcccacgcggcaggatggccccgaggatgcggccaaccgtggccatatgccggctggccagggaggcggccagttccagatagccggcgtcgcaaagcggcgcgcgctccaggggccacagggccgggcgcagggtcacgcccgggggcgcggcgacgccgcagccggccaccacgcccacgcgcagcgtcctgccaaccggaaccagcaggcgcaggcccaccggaaagtcggcgagggcaaacccgtccggcacggcataggtcagcacgctaaaaggcggggtggtcagggcgacggccagggcgtcgttcatggcatggcaaaaaaatcgcccgggaggcttacgcccccgggcgacaaaaaggtgcggacaagggcgacgggcctagttgccaaacggcaaaagctcacgcaggcgaggcaccagggactcgcgcagaacctcgtcgtgcagggcgaagtagatgttggcggtgaggtagtcgacccagtcgccggcgtcgaagcgctggccctgaatcttgacggcgagcaggcggttgttgccggccaagcctttgagggcgtcggtgagctgaatctcgccgccgtggcccggggtgaccttctccaggtggtagaagatgtccgggaacagcacatagcggccgacgatggccagccgcgacggggcttcgttgaccttgggcttttccaccagatcgcgcacccggtacatgcccggggcgaattcctcgccgtcgatgatgccgtagcgggaaaccatgtgcggcggaacttccatgacgcctatgaccggcatgtgctcggtcatggccacggtcaagagctgcttgatgcccggttccatgctgaacatgaggtcgtcgccgaccatgacggcaaagggatcgttcttgcagacctcgcgggcgcacagcacggcatgccccaggcccagctgctttttctgacgaacggaaatgatgttgaccatctccgccacttcccggaccatcttgagcatctcggtcttgttggtgcgggtgagcagatcctctaaggtgaggttgtaatcgaagtggtcttcgatgatggtcttgttgcggttggtgacgaacaccacgtcctgaagccccgaggcttgcgcttcctcgaccacgtactgcacgacgggtttgttgtagacgggcagcatttccttggggatgttcttcgtggccggcaaggaccgcgtaccccatccggcgacgggaatgaccaccttcttgatttccatgctcttctccttgaatgcgcgcactgcccgggtattttctcggaggcggcggcccgcgcaaacgcgccggccctccggatgatgacctctccgccgaggccgcgccctcccctttcggggcggccggcatcgcctcgcgaagttaattcgtttagataaacaagtccagccccaaaagggagttccagggctcctcggcttaagccagagccctggccaccacctcggccagggagtcgcacagcgactcgaccagggccgcgtcctgggcctcgaccatgacccgggccagggattcggtgccggaatagcgcaacagcacccgtccacgcccggaaagggtcgcttcggcgtccttgaccgcggcttcgatggccggggcctcgctgaaagggatttttcgggccacgggcacgttgacgagtttttgcggaaacggggacaacagcgtggccagttcggacagcggcttgcccttgcgcaccatgatcttcatgagctgtagggcggccagggtgccgtcgccggtggtgctatgatttaagaagatgagatgtccggactgctcgccgccaaacaccgcgccctgggcccgcatggcctcgaccacgtagcggtcgcccacgggggttcgcagcagccggccgccgtggtccttcatgaacacttcaagggccatgttgctcatgaccgtggccacgagcagattacctggcaaagccccccgctccataagatccagggcgcagatagccatgatctggtcgccgtcgagaatccgccccttttcgtcggccacgatgacccggtcagcgtcaccgtccagggctatgccaatgtcggcctcggcctcggcgaccatgcgggccacctgctgggggaaaagcgaacccacccgctggttgatgttggagccgtcgggatcgacgccgatcttgatgaccttggccccgagttcctcgaagacctggggggtcacccggtaggccgcgccgtgggcgcagtccaggacgatcttgaggccctcgaagttgacgtccagggggatggaatttttgagaaacacgttgtagcggccggggctgtcctccagcttgaaggcccggcccacatggtcgggatcgggcagacgccagtcctgggcatacccctcgacccgggcggcgatctcggcttccacggcgtcggggagcttaaaacccatgtggtcgaaaaacttgatgccgttgtcgcaggccgggttgtgggaagccgaaatcaccacgcccacgtcggcccgcatgtcgcgggtgagaaacgagatggccggcgtcggcaacggcccggtcaaaaagacgtccatgccggcggcgcaaaagcctgaggacagggcgtattcgtagatatagccggaacgtcgggtgtccttgccgatgagcaccttgtggcggcggctgccgtttcgaaagtgcaggccggccgagagagccaggcgcatgaccacgtccggggtcatgggataggcgttaacccgtccgcgcagtccgtcggtgccgaaaagcttgttgtccattccttgattcggccggttcacgccggcctcatttgacggtgagggaaaccttgtcgggcttggcttcaatgagctcgcagccctggggcatcttgacccggtaggaagcctcgtacttgcccggctggatgtcggcagccagttccaaggcggcctcgaccaaccccgggaaatccttgtcgccgatgatggccgccggtcccttgacccgcagcgtgacggcctggggcgaaacctcggcctctcggcccttgggttttttgacggccagcggcgcgcgcagcgtgatctccgattccttggcggcaaagcccatgaccacctgtacggccggcggcgaggcatcgacgtcctcgggcacgtccaggggcacccgttcgtcgtagcgcgccggaatcggctggggcacggtaatgggctgggtacggatctcgctgatcttgtcgagctttccggccggcccggacaggcgcacggattcgggcacggcccgcaccgccgacatggaatacccgtccgggagcgatgaccgcagcatcaccttgaccggcacggtcttgacggcgcggcgctccacctccagctcaagccgggccgggcgtatctccacggcctcgtaaacctttggcaaaacgatatttctggcctcaaaaaggacgatgttgcgtcccggaacaatcttggacaagttgaggttgtagacaagctgggtctcgtcgatcttgcgggccacgcctcttggaccgcgcaccagcacgtccaccgcccccaacataccggatttgatgtagaggtcttcgggcaaccccgtcatctccacccgcatgggcatccaggcgtcgactttttcccggcctgtgaccagataccagcaaaaaagcgacaaggccagggccagggccaggtattgccagttcgatttcatgggcgtttggccgtgaggttccacaacatgtttttaagcgtcaactcgtccaccggggagatgagcttgcccccttcggccaccgacaccacgccccgttcctcggagaccacaacggccaaggcgtcggtttcctcggtaatgcccagggccgcccggtggcgggtgcccaggctcgcgtccaggggcacgccggcgatcagcggcaggatgcagccggcggcggccacagtatcaccctggatgatgaccgctccgtcatggagcggcgtgtccgggaaaaagatggtgccgagcagttcgcggctcggtctggccatgagttccactccccgctgcacgtagtcgccaaggggcaccagacgctcgaacacaatgagcgccccggtgcgagagcgggccatctggaacacggccaggacaatggcgtcaagggccgcctcggatacctcctcgcgccgcctggcccggaaaaacccgcgcgtccccactgacgacaaccctttgcggatgtcggcctgaaacaggatgatgatgaccaggaaaatggagccgaggaagttggtcaaaagccagtgcagggtgttgaggccaaataggtcggaaagatagtagaccacgaggatcaagagaaaaccgtggagcaccgtggcagcccgtgtgccgcgaacaagaagcaaggcctggtagaagacgaaggttacggccgcgatgtccaggagatcacgccaggacaggtggaagttgtcaaaaaagcttcccatgatggtacggtcctgcggcgaaagccggctcagccggccagggcggcggccaggcccagggcttgtttgacggcggcgacgtcgtggacgcggtgcaggcgcgccccgcgcccggcgcacagggccgaggccacggccgtggccacggtgcgctcgcccacgggcagcccaaggagcgcgccgaaaaacgacttgttggacagcccgagatagaccggccggccaaagaccgtaaaccgttcaagattgcgcaaaatttccagattgtgctccgagagcttgccgaaaccgatgccgggatcaaggaccacatggtcctcaggcagcccggcccgagtcaggcgcgtgagcccctgttcgaaataggccaggatttcgccgattacatcgtcgtaacgggggtcgcgctgcatgacgtcaggccggcctttggtatgcatgagcacgtagccgggctggcgctgcgcaacgacctcaagcagcgccggatcgaaagccagccccgacacgtcgttgaccgcgcaggctccggcggccagggcggcggtggcgcagccggcccggtaggtgtccacggcaatgggcatgtccggcagtcggcgggcaagctcggcgatgaccggcacgacccggtcgatttcttcggcgtcggtgacaggcgcggccccggggcgggtggactcgccgccgatgtcgagcatgtcggccccttccccggccagacgcaggccatgggatacggcggccgccacgtcgccgtggcggccgccgtcgtagaaggagtcgggcgtggcgttgacgatgccaatgacgcggtccccggagcagtccagggtccgcccgccgcccaaccgccagatcgaggccatgtcctgctccatggagtcgccagggccgcttatgggcgcagtggaacgtatctgtcgcatggtgggccgcataggccggccaagccgctggcgcgagctacttcgattccttgccctggccctggccggagccggcgtggccggaggaatcctcgggctgctggccgtcgtcaggctccagggtgaactcgtcgcctgtccccgtggctgtctcagccgtcgtcgcctgggcggtggcggctccagaagcggtttcgggcccgctcgccggcgaggcggcggcggaagtcccggccgccccgcccggtttcccggccggggcttcctgcggggggagttgttcaccccgcagcaacatgtcgatgtcggctccggagatggtctcgcgttccagcagcgccttggccacggcttccaaggcttcgggctcgccttcaaggatgtttttggcccggcgataagccgattccacgatcttgcgcacctcggcgtcgatctggcgcgaggtctcctcgctgaagttgcggtggtgcaccagatccttgccaaggaatatctcgttttcgctctcgccgtaagaaagcggccccagcacctcgctcatgccccaggagcagaccatcttgcgggccatgttggtggcccgttcgatgtcgttgccggcgccggtggtcaactggttgagcacgagctcctcggccacccggccgcccatgagcacggccagattgttttgcaggaagtcgcgggaatagttgtgccggtcgtcaacgggcagctgcatggtgatgcccagggccatgccgcgcggaatgatggagaccttgtggatggggtcagtgccgggcaacttcttggcgaccagggcgtggccggcctcgtggtaggcggtggtgcgcttctcgtcatcggtgaggatgaggctgcgacgctccttgcccatgagcaccttgtccttggcgtgctcgaagtcggccatgtccacccgatccttgttgatcttggcggcctgcaaggcggcttcgttgaccaggttttcgaggtccgcgccggaaaagccgggggtgccccgggccaggacctcaagatcgacgtccggggacaggggcgaacggcgggtgtggacttcaaggatgcgccgacggccgcgtacgtccggggtgggcaccacgacttgccggtcgaagcggccgggccgcagcagggccgggtccaggacgtcggggcggttggtggcggcaataaggatgacgccttcgttggattcgaagccgtccatctcgaccaggagctggttgagggtctgttcgcgctcgtcgtggccgccgcccaggcctgcgccgcgctgccggcccacggcgtcgatttcgtcaatgaaaatcaggcatggggcatttttcttaccctgcaggaagaggtcgcggacccgggccgcgcccacacccacgaacatctcgacgaaatccgaaccggagatggaaaaaaacggcactcccgcctcgccggccacggcccgggccaacaaggtcttgccggtgccgggcgagccgaccagcagcacgcccttggggatgcgcccgccaagacgggtgaatcgcttcgggtcggaaagaaactgcaccacctcggtcagctcttccttggcctcgtccacgccggccacgtcttcaaaggtgatgcgcgtctgttcttgggtgatcatacgggcccgggagcggccgaaattcatggcccggccgccgccgccctgcatctggcgcatgaaaaagatccatacgccaaccagcaggagcatgggaaaccaagacacgagcagcgtcatgtaccagggcgattcctcgtccggttcggccatgacctcgatctttttcgccatgagcgagccgacaagattcgggtcctcgggggcatacgtcaaaaacttgccgccgcccgttgccacgcccgtgatttttttgccctggatcttgacggagaccacgtctccggcattcaccttctgcatgaattcggaataggagagcttggcgctttggctctggggctggttaaacaagttgaacaggacgaccatgaccagggagatggccgcccagagcatgagatttttcgcgaagctgttcaaactggagtcctccaggggacggatggggccgaagcggcccgttggttgtataaggcaaaagtcctaacacagggccgcccgacctgtccacgcgggcgcaaacgcccccgccgcgcgcccgggaaggcttgccaaggattccgatgcctcatatgttcacctatggtaagtatcgaggccagggccggcaaggagtagtaatggccgaaaaacgaattttgaccgtggatgactcggtgagcgtgcgttccctggtatccagcgccctgcgccaagccggtttcgacgtggtcgaggccgtggacggcgccgacgccctggacaaggtcaacagcggcttcgacatggtcatcaccgacatcaacatgcccaacatcggcggcatcgagctgctgggactcttgcgggagcggcccgacacccggttcacgccagtcctcgtcctgaccacggaatcgcaaaaaaacctgcgcgacaaggcactggccgccggcgcttcgggctgggtggtcaagcccttcgaaccggccagcctcgtggccgtggtgcgacgcttcatcggccgaacatgacgaacccttctccgcccgaaaccgagccaaaccgcgccgccgacgcggccatggccgacgccagcgccctgctcttccacgacgtgcccgcggccgtgtatctgcgcgccttggacggcgcgtttctggaggtcaacaacgccacggccgcccttttcggctatgtcgacccggccgcctttctggccgccatggccgactgcccggaacaattctacctcgaccccaatgcccggaaatccgttttggatgaactcgccgccggcggcgtggtggccggccggcgctatcaggccatgtgcggcgacggcttcgtgatctggatcgaggaatcggccaaacgcacggtttcacctgcgggagacgtcttttatgtcggcttcctgcgcgacgtcaccgaggaaaaaagcacgagctgggccttggccgaggccgaagaaaaataccgcaccattttcgaaaacgccgtggaagggcttttccagatgacgccggccggacgcttcgtcacggttaacggcgccttgtcccgaatgctgcgttttgcctcccccgaagctttgaccgccctgggcgacgcggcggccaacctcttcacccaccccgaagaccggcaattcctccacgccgccctcagcgaaaccggtgtggtccgggccatggaaaccgaactgcggcgcggcgacggcacgcgcatctgggtgtctgtccaggccagggccgtgcgtggcggcgacggcgcggtggtgctctacgaaggctccatggaagacgtcaccgaacggcggcgctcccaggaggccctgcgccacaacctcaagcgcaccaaggcgctgtttcaccagaccgtcaaatcgctgtccaccaccgtacgcttccgcgacccctacaccgccggccaccaggactcggtggcccgcctggccacggccatggccaagcgcctggggcttgaccgcgacgccgtggactgcatccaggtggccggccagctccacgacatcggtaagatcagcgtgcccgtgcgctacctgtgcaagcccggccggctcatcggcctggaatgggaattcatgaagcagcacgcggccacgggttatgaaattttaaaggacatcgacttcccctggcccgtggccgagattgtcctttgccaccatgaacgcctggacggttcaggttaccccagaggccttggcggcgaagaactgtgccagccggcccgtatcctggccgtggccgacgtcctggacgccatggcttccaaccgcccctaccggccggcgctgggcgtctctgtcgccctggaggaactggcccgtcaccggggcacggcctttgacgccgacgccgtggacgccgccagggaagccgtgagcgccggcgacgtgacctactgatcccgcccatgcgcctgaccgattccgatctcctgcgcgacctcgacaaacccgaatttgccgccgtgcgggccgctttcgtgccccggcacttccccaaaggccggcaggtgtacgccccgcgcgaagcccgcaattccctgttcatcgtggccaagggccgggccagggtctacctgtcctacaaggacaaagaattcaccatggccatcctggacgtgggcgatgtctacaccacccacacccgggcctcggtggaagccctggacgacctgaccatcctcgtggccgagttggccgccgtgcgccgtttcctggccgacatgccggcgctgacctcctccatggtcaaggtgctcggcgatctcttgtcccacgccttctcggtcattgacggcctggcctttctcgacgtgcggaaacgcctcatccagctgctgctctacgaagccgaacgggccagcgccgacgccgagcacatcctgtgcttctcccatgggctcaacatcgaacagttggccaccattgtcggctcctcccgccagaccgtgtcgtccctcttaaatgtcctcgaacgcgacggcgtcatcgagatgcgcgcccggggcgtcatctgcctgcccgacttggcccgcctggaagccctggtccacgagtagtttcagagcgcctttgtcggcaatctgacagacacggtcgtccccggatcgtaaccaaggccaaacgtccgcgcgcgccgggtcccccggcctcgcgccaagggaggatggcatggccaaggatacgagaaccatcgaggaactgtcgccgtgggaagatgcccgccggatgcttgccaaggcaaaggacgaaggcatcgccacggtctgggaccggttggccgaacagacgccgcattgcaccttttgcgaccaggggctgacctgcaacaagtgcgtcatggggccttgccgggtgaaccccaagggtcccaagcgccaacttggcgtgtgcggggccgacggcgacctgaccgtggcccgcaatttcggccggttcgtggccgccggcgcggcctcccattccgaccacggccgcgatctgctggaagcccttgaatccgtgggccagggcacggctccgggctacgccgtgcgcgacgcggacaagctggtccggctgtgcgccgaagtcggcatcgaaaccaaaggcctggacgctcccgaccaggccaaggccctggccgagcactttttcgaggacttcggcacccgccgccccgctctgtcgctgctctcccgtgcccccaaaaaacgccgggaaatctgggacgccgcccgctccaccccgcgcggcatcgaccgcgagtgcgtggaaatgctgcaccgcacccacatgggcgtggactgcgacccggtctccatctgcctgcacgccgcacgcacggccctggccgacggctggggcggctccatgatcggcacggaactgtccgacatccttttcggcacgccgcgtccggccacggtcgaggccaacctcggcgtgcttcgcgccgacagcgtcaacattctggtccacggccacagcccggtggtctcggaaatgatcctggccgccgcccgcgacccggaaatggtcgccaaggccaaggccgtgggcgcggccgggatcaacgtggccgggctttgctgcaccggcaacgaggtgctcatgcgccagggcgtgcccctggccggcaaccacctcatgaccgagctggccctggtcaccggagccgtggagatggtcgtggccgactaccagtgcgtcatgccgagcctggtgcagatcgcttcctgctaccacacccgtttcgtctccacctccgaaaaagcccgtttcccgggcggcacgcacctggaattcaccctggaaaatgcccgggacaaggcccacgaggcggtggagctggccatcgaggccttcacccgacgggacgccggccgggtggacatcccgtccgtcccggtgagcctgcgcaccggctattccaacgaagcggtccttgaggccctgggcggttcagccgaaccgctgttggccgcgatcaagatcggcctagtgcgcggcgtggtcggcatcgtcggctgcaacaaccccaagctgccccatgacgggattttgaccgggctagccaaggaactcatccgccaggacatcctggtggtggtcacgggctgcgccacggtggccatgggcaaggccggactcatgaccaccgaaggcctggagcaggccggggtcgggctggccgagttctgttcccggttcgatctgccgccggtgctccatgtcggcagctgcgtggacaactcccgcatcctggccttgtgcggcctgctggccgatgccctgggcgtggacatcgccgacctgcccgtggccgccagcgcgccggagtggtattcggaaaaagccgccgccatcggactttacgccgtggccagcggcatcatgacccatctgggcctgccgcccaacatcctgggcagcgaactggtcacgggcctggccctggaaggcttggaggacgtcttcggcgccaccttcgtggtcgagcccgacccggtcaaggcggccgaggccatcagccgccgcatcacggccaagcgcctggccctgggactcaacgaccgtttcgacggcgcggttttttcttaacgctatgaacgacaatcctgtaagcgccccgaccgcagcccgtttgtccccgggttcctggaacgctttgacgcagggcctgcctagttcggacggccaactcaggcggccggtcagaaaaatcgcctttgccggcaagggcggcgtcggcaagaccgccctggccgcgcttttcggcgactggctggcccggtcggggcaggacgtgacactcattgacgccgacacggccctgtcgctgggcgcggcctgcggtctggaaccggccgccctgcccgcctccctggccgagcgcgaggatctcgtgcgggagcgcatcggcgacggcgtctatctcaacctgacgccccgggcggacgatctacccgaggccatccgcgtcgccgtcccggtcggccacgggccgctctacgccccccgccccggggccaagcggctgctggtcatgggcggggtcagcggcggcggcgcgggttgcgcctgcgccgccggccatctgctccaggccatgctggcccatgtcctgaccgcccgggacgcttggacgctcatagactgcgaagccggggtggaacatctgggccggggcacggtggccgatgtggacgccttaggcgtggtcagtgaagcctcggcccggtccctggccgtggccggacgggtcgcggccatggccggccagctcgggctgacccggcaagtcctggttgtcaccggggtcgatcaggccgggctggccgcgttggccgccctgccgccaacgctgccggatgtccgggtcgccttccccttcctgccagggctggccgcccgccaggcgaccacaggcagcgtgctgtccctgcccgaagtcggcttggccgacgccgcctgcgccgccttggccgaggccttgggacgggtctaagcgggggcgcttcgcgcccatggctatggccaacagcacccgctatcgcccgatcgggcatggcgcgccacgttctctcgcccggcatgcggacgcaggaaccgctctttcgtcggccacgacgcacgccccccggagcacgacgacgcaacgacagccaaacatcccacaaaaaaagggagcggcccggaagccgctccctttttggcgtttacgcgctcgagaactaggcgaaagccttctcgaagggcggcacgacctgctttttgcgggacagcacgccgtcgagccacacggagtcgcctttcacttcgacgccgaaggccttggtcacgtagctgggatcgtcggagacgatcagcatctcggaaccttccttcatgatgtcggtcaacagcaggaagacgctgtggcggccttcggccttgaccttcttgcactcggccaacaggtcggccttgaccggctcaaggatggacagatcgacgacttcgagctggccgatgccaaccttcttgccgcccatgtcgaagtccttgtagtcgcggaaaacgaggtccttggccggggtgccgcccacggcggacttgatcttgaacatctcgacgcccagagccatgtagtcggcgacgccagcgatcttggccagggcctcgacggcttccttgtcggccggggtgcaggtcggcgacttgaacatgacggtgtcggacaggatggcgcacagcatgatgccggccatgggcttggagatctcgaccttggcgcagtcgtacatcatcttgaccacggtgcaggagcagccgacggccttgaccaggatgtccaggggattggaggtggtcacatcgcccagcttgtggtggtcgtagatgccgatgagttcgcccttggagaggttctccaggctctgggccagatcggagtggtcgaccaggatgatcttcttgtcggtggcgtcggtgacgatctccggagcggccacgccgaacttttcgagcacaaaggcactttcgggattgagcggaccctgagcggcggcgatagcgcccatgctctgggacttgttcatgagatcggcaacggcaatggcggcggcgacggaatcggtatccggatttttgtgaccaacgacgtaaacagccatgtctttttcctcctgggggtttgtccaagaccctgacgggtcggcatccgcgtgagtaacttgtgaataatatcccaatagtcgtctcttgccaagcccaaaccgggccggggcgacgtcttttttcccgaaagtccagccggaccacaaggccggccatgtgaaaaaagcctagaaaaaccgccaagccacggccaaacccatgccgccggccaaggcggcgtaggccggacggtagcgcagggacaagaccgcccccagactgccgagaatccacagctggccccagctcgcccgtgaggacgcaagatacggccacactttgggcaaggccaccgcaaaaagggcaataaggccggccagagccacggcaaagaccaggccttggatgacgacggtgttgaccaaggcccggcggatgagtttgcccggctcaaagggggcacgctggcgttggcgggcggcggcgtagcgagaaaagacgatgttttccaccacccgctgggccccctcaaggccggaaaacaaccgagccaggaccgaagtggccccggccacgcacagagcctcggccggggtggtcagggaaaagacgtgcatgagcgacaatccggccagggtggcggcggcggcgttgggcggaatgtgggtgccggcgggaatgccgtcgagccagaaaagctcgtagaagatgcagagattaagggtggcgggcagatcgccctgacacaggccccaggccagaccgatgaccagggggcgttccagcagggcggcgtttacggcaaagcggaacgaggagcacaggacaaaaaaaaagcgacgccaaggacgtggagcaagatgtcggcctgatgggtcatggcatgggcctcgcgggggttaccattggggcgtgggccgggtcagaccctgggctgggccggatcgcccggcacgcagcggtagtccaggcgtacgcccttgtcccggaaaaaatccaggcaggactcatcttccttggacagggccacgtggggacagacttgcctcttgcctggggcgtagtggagattgccgagattcaagttggcgaaatcgaacccgtattcgtaggcgacctgggcatcgcggcaactggcgaacaggatcagcgcctcgggcaggtccaggggcgcatggctgaaatagccggccagatcggccacgggcagaaacacgatggccacgccgtcggggatggccagggacatgatctcctggcggagatgatcggcggccaagtcgtcgttgaccaccacaatccggctggcgtgggtaaacggcagccaggtctcgatgatctggccgtggacaagccggttgtcgatgcgcacgaaggccatggctacccctcggccacctttttgcgcagcacctcgccagccacgacgatgccctggcagccggcctgcttggcctccacggccagggtttgcagggggcgagtgcgcgaacccaaaattttgatgagcatgggcaggttgacgccggtgaggacctcaagctgccccgaacccaaaagcgacaggctcatgttggtgggcgtgccgccgaacatgtcggtcagcaccaacaccccaccgccctggtcggtgtccttgatggcggccttgagcgcggctagggattcgtccacggccttggtcagatcgacgctgacggcttggcagtgctgctgggggccgaggatgaactcggcggcggcaataagccgcgacccgtagtcggtgtgggtgacgaccaccacgccaacgggcgcgtccttgcgggactcggcattcatagacaggcatcccggagcatggcgcccccgtcttgacggtttgaaaccgtcggcattgctttctgcttccggtccggccgcgccgcccgaaagcccaaggcctcacaccatagcggtctttgaacgaggctaccgagccgacaaggctaccggccgtgacggcacgctgtcaccaaacacgaaagtccctggaccgggctcgccgccccaccgctctcgccggcaaccacgttgccgcggcgttcaaaacctagagtttagccgcgttcgatgtgccgatgttcaagggagatattgtagccagccttggagagcgtgtcaaagaccgactcggccacggccaccgaacggtggcggccgccggtgcagccaaaagccagggtcaggcggtaacggccttccttggcgtacagcggcagcaggtagagcagaaattcggtcagccggcgcaaaaactcccggcccggctcctcggccaggacgtaatcgcgcaccgccgcttccttgcccgtgcgctcgcgcagttccttgtcgaaatagggattgggcaaaaagcgcaggtcaaagaccatgtcggcctcggagggcgggccgtacttgaagccgaagctcatgacgtggaccttgagggttccggcggtgggccggatggaggcccatttttcctggagcttgcggcgtaggtcgtggatggtgaaatgggtggtgtccagcaccatgtcggcggcgtcgcgaaggggccgcatgcgttcgcgctcggccagggcggcctgctccaggcccatgtcggcgctttccaggggatggggccggcgggtagtggcgtagcggcggatgatctcaccgttatcggcctcgaaaaagatgatctgggtaaggtcctgtttacgccgcacctcggccagggtcgcgccccagtcggtgtcgaggtcggcctggcgcacgtccatgcccagggccaggcccttgtagcgctggccgcccttgtcgtcgaaaaggctcatgagcttgggcacgaggctgaccggcaacccgtccacgcaaaaaaaacccaggtcctcgaagacgcgaagggctgtggattttccggacccggacaggccggtcaagataacgacggggagttccctggccgcatgttccatggcattcaccttccggcccaagggcttaacaaatttcccgcgcgtttgtgtgacaacaaacgcgcgggaaacgttttttcagggagccttaggcggcggcgagcacctgccgcaaggcctcgtcggtttcggcggtcagaaaggcccgccggaaggattcatcggacaaaagccgcgagatgtgggccaaaatgcgcaaatgcaggcccgcgacatgctcgggcgcgagcaccaggaagaagatgcggcagggcttgaagtccagcgcatcgaagctgacgcccgcaaggcttctcccgacgacgatgacgatgcgttcgaggctctccatcttgccgtggggaatggccaccccgtcgccgatgcccgtggttccgaggttttcccggtcgagcagcacctgatgggcgcgtttggcgtcaaaatcgggccactgcttcttgatgggggccacgagctcggccaacacttcggacttggactccgacgcaagattcccgatgacgaactcgggctggagatagtcctctaaccgcatctaagcgcccgttccaggatcgatgaggccgaagtcgccgttgcgcaggcggtagatgacgttgggccgttcggtttcggagttgatgaacaccaggaattcgtacttgagagcctccagctgcatggcggcttcttccacggccatgggcttgggctgatactcgtcggtttcgatgatggtgggcacgcggccgccggcggcgtcctcgctgatgctgatgacgtccatgcggacctgttccacggtctggcgacggcggtccttttgcttctcgcggaacttcttggcctgggcctcgatcttgtcgaggatcaggtcaatggtggagtacatgtcctcggaggtttcgtgagccgagatgtgcatattgtcggccaggaagatgacgtcggccatctgccgggtcttttccacggccaggttgacctggacatccgaggtatcggtggacgaggtgtacttgccaagcttttcaaagcgcttcctggcataatcgcgcaaatgatcagacggctcgaaattcttgaaattaaaggtgatgttcatagaatcctccaggctggcgtggtgagaggccggaaacccggcccgaagcatcagaaaaccgccttgcgcttcgacgacgactcgattcccatggccgtgcgatacttggccacggttcgccgggcgatgttgatttgcagttcatccttgagcatgtcggcgatggcctcgtcgctgatgggctttttgtcattctcgccggaaataatgcgcttgatcatggccttgaccgactcggagcctaccgtgcccccgtcgtcgagttccagggcgctgttgaaaaagaacttgagttcaaagatgccgtggggcgtggccacgtacttgttggacgtaatgcggctgacggtggactcgtgcatgctgatgtcgtcggccacgtccttgaggatcagcggccgcagcttggtcacgccgtcctcgaaaaatccgcgctgaaacttcacgatgctctccaggaccttatacagcgtgcgctggcgttggtacaggctcttcataagccacatggccgaacgcatcttgtcctggaggtagtccttgtccttgtcgtttcgcggcaggctgccgtcggtgtaggacatgttgagtcccaggcgcggcatcccctcctcgttgagcaggatgacgaagtcctcgccgtacttgtagacgaaggcgtcggggctgacgtagatcgggtcccccgaaccgtagctggctccgggcatgggatcgagggtctggatcagctccaggtattccttgagcttttccatggtcaggtgaaatttcttggccaggggcttgtagcgcttcttttcgagatcttcgagatgctcgcgcaccagttcgatgaggatgggatcgtcgtagccgtagacttcgatctgaatgagcaggcattcgctgggagtgcgagcggccacgcccacgggatcgaagcgctggaggcggtggagcaccttttcgacatgcgccgggtcggcgttggccatgccggcgatttcctcgaccgtggcccgcagatagcccgaggaattgaggctgccgacgatggtctcgccgatctccacttccttggccgtgaaattggacaggtgcatctgccagccgaggtggccgtcgagggacggcttggaggccaggcgagcgtcgaaagccatgccctcttcgggaacttccaggtcgcgggacagggactgcttgctcgtgctggcgaaatcgccaaggtagtcgtcccactcggcgtttttgagcagctccttttccatggccgcgtcggctcccgtggggccattgttgtcctcgaccatgacgcgttcgggctggcggtcctcctcgacggattcctccagaagaggattttccaaaagctcctgctgcacgctttcaagcagctccagccgcgacagctgcaagagcttgatggcttgctgcagctggggggtcatcaccagctgttgggaaagcttgagttgctgccgcagttccagggccatgcttaccgccgtgctcgaaagtcgttgacgttaccggggtcgtctccgggctttgcccggctcagggccaccccgcccaacaaaaaccatgccacaattgaagccttgtggcaatcggcacaatcggccttcagccgaggaaccactggtaggccgcctccagacggcccttggcggccaaaatgtagcgcacggcctcgcgcacggcgccctgcccgcctccgcgccgcgacacccacaaggccagatcgaggatttcgggctgggcgtcggccacagccatgggcagaccgaccagctccatggggccggcgtccacccaatcgtcgccgagaaaggcggcctgatgcggggccagcccggcccgggccaggatgccttccagcacggccaccttgcggtagtggccggggtggtattcctcaatgcccagttcccgcatccgggcggccacggccgggctgtccaggccgctgacgaccgccacggccagccccgccgcctgggccgccttgatgcctaaaccgtcgtggacatgaaaacgcttggtcacctcgccccgggcatcgacgtagatgccgccgtcggtcatgacgccatcgacgtcgagcaccagcaactccacgtcccgggcgcgcgcaatggccagcttggcgtcttcaggcataacagcctcccttgcgatgcgacggcggcatggtttgaacgcaaggccatgtccccaaccgccgacaggtgcaatctagcccaaaaatcgcaccatgaccagaagataaacgtttttagcgccttgccaagccatgcagccctttggccgaaaaaaagtccggagaagccgccttccccggaccgtgcaatctttttgcgcttgggccgtctagcccttgtgccgcttggccgcggccacgaactcgcggaacagcggatgcggacgcatggggctgcttttgaattcgggatggaactggcagcccaggaaccagggatggtcgggcagctccaccatctcgaccagttcgccgtccggggacaggccgcttaagaccaagccggcttcctcaaaattgccggcgtaggccttgttgaactcgtagcggtggcggtggcgctcggagatttccgacgcgccgtaggcggcggccgccttggtgcccggcgcgaccacgcagggataggcgcccaggcgcatggtgccgcccttgtcgctggtcgggtcgcggtgctcgatggtctgggtgcggaagtcgtaccactcgcgcatgaggtagatgaccggatgttgcgtggtcaggtcgaactcctcggagttggccccgtcaaggcccagcacgttgcgggcgtattcgatgaccgcgcactgcatgcccaggcagatgccgaagaaggggatcttcttggtgcgggcgtattcgatggaggcgatcttgccttccaccccgcgcgagccgaaaccgccgggaacgaggatgccgtcaatgcccgaaagcgtggcggccacgttttcccgggtcagctcctcggagttgacgtaaacgaaattgaccgacaccccggcgtggacgccgccgtggaccagggattcgtgaaggctcttgtaggcctccttgaggtccacgtacttgccgacgatggcgatggacaccgtaccgaccgggttttccaggcggtacatgaggtcgcgccagggttcgagttcggcgtttttggccggcaggcgcagtaaaatggcgatcttctggtccacgccctcgccgtagaggcgaagcggcaactcgtagatgctcttgacgtccacggccgtgaacacggcgtcggcgtcgacgtcgcagaaaagcgcgatcttctgcttgatgtcccgggccagatccacttcgctgcggcagatgatgatgtcgggctggatgccgatggagcgcagttccttgacgctatgctgggtgggcttggttttgacctcgccggccgtgcgcaggtagggcaccagcgtcaggtggatgtagagcgcgttttccttgccgagttccattcgcagctggcggatggcctccaggaagggctggccctcgatgtcgccgaccgtgccgccgatttcgatgatggccacgtcctcgtcggtggcgacacccaggatcgagcgcttgatctcgtcggtaatgtggggaatcacctggacggtgccgcccaggtagtcgccccggcgctctttctggatgacgctgaaatagatgcgcccggaggtgaagttgttgttctggctcatgggcacgccgaggtagcgctcgtagtgcccgaggtcgaggtcggtttcggccccgtcgtcggtgacgtacacttcgccgtgctggaacgggttcatggtgccgggatcgacattgatgtagggatcgagcttctggatggtgaccttgagtccccgggcctggagcagcgcgccgatggaggcggcggcgagtcctttgcccagggaggacagcacccctcccgtaacgaaaataaacttggtcttcatggcatgccgtccttgtttcacgggtccgtcccggcgaccccggcggaatgcgccaaccgccgggcctgacgcgcgggcgcggttgacgcggccggtgcggccccgtatgttcagccgcgcaaagtaagctttcggaagcaatttttcaaggaacccttgggaggatttccccgtatgcctcaggtgcgcaccctcgtgatcaccggtttcggctccaactgcgaggtcgaatcggcccatgccgcccgcatggccgggtccgatgttaccgacatcgtgttcttttccgacatcgtggccggccggacacggatcgacgcctacaattttttgatctttcccggcggatttctcgacggcgacgatctcggcgcggcccaggccgcggccgtgcgctggaaacatgcccaaaccgctgcgggcgagccgctgctggaccagttgcgcgccttttttgacgccgacggccttatcctcggcatctgcaacggctttcagcttctcgtcaagctcggcctgctgccggctctcggcggggcttacttcgcccgccaggtgagcctggccaataacgactcggcccgcttcgaggaccgctgggtgacgctttgcgccaacccgcaaagcccgtgcgtgttcaccaaggggctttcggtcatcgacctgcccgtgcgccacggcgagggcaagctcgtgcccatggaaccggccgttctcgacgagctcatggccagcggcgcggtggccctgcaatacgccgacccggccacgggcgcggtcaccatggactatccggccaaccccaacggttcgccccaggccatcgccggactgaccgaccccacgggccgcatcctcggactcatgccccatcccgaggccttcaaccatccgaccaaccaccccgattacacccgaggcgcgcgcccgaccctgggcacggccctttttgaaaacgccgtggctttcctgcgcgcaggggcctgatcggacttcaccgccagctgacggcccggccgggagcttcccgcgccgggccgtttttgccgccgcccgagaacgcccgccggcctgaggccagcgccgccgctcaacgttgtagcgaaggtgcagacttcagcccggcaaggcgctccccgcgtcctttttgccgcgaacacccggcgatcagaaaagtcgtgtgacctttgcctctggccaacatgccgccgcaacaagaacctctaccgccgcgctcccctgccaagcgcgccagccggacaaacgccatggctctcgttcccgccaaacgcttcaacgccgctttaggcgaattgcccgccccgccgccgggctggccggatttcgaggcagtgatggccctggccctggccgaggcccgggcagcggcggccgtgggcgagacgccggttggcgcggtcctgctctctgccgcgggcgaactgctggcccgggccggcaatgcgcccatcaccacaaacgatcccacggcccacgccgaaatgcgggtcttgcgccaggcggcggccaaggtcggcaactaccggctgccgggcacgatcctggccgtgaccctggagccgtgcctcatgtgcctgggggccatgatccacgcccgggtggggctgctcgtctacggcgcgacggacccgcgttgcggggtcgtcgactcccggctccccggcccggatctgccttttttcaaccaccgtttcaacgtggtgtccgggatcagggccgaagaatgcggcgggattttgcggaatttctttcgggaaaagcggcgcggcggcgcgggttgaggcatgtttgcggcccacgcgaaaaaatgcttgccaagcggccgggccgaggataatttcccgactcccttccagctctctgtgcggagaggtaccgaagtggtcgtaacgggcccgactcgaaatcgggttgcgggttaatagcctgcacgtgggttcgaatcccaccctctccgccaatcaataaaatcagccacttacaatctccagcgacgtacaaacgccgctgtttttcttgcgtccaacaacggcctgcccatcgacctctttcctctcccgcaaatagcaattacgccctcgccccgcagctatacaccgcctctatgtccccagggctatatccggggcatcgacagccccttgaagacggttttcaatgaatacgctctgtttcgtcctcaccttggcccttattgtcggtcttctcggcctgaccgaaatgtttaatcggctggccaggagttgaccatgggttccgtcgtccttgcccttgaggcgaccgacgccggcgcttgggcctgggccaaaataaactcgggatagctggagcgaaacagttgtctggcctgccccaggctggccgccaggaattcgccggctgggatgcccgtttcctccaggcagcgctccaccgcttcaatgacggcaaagttgaacgtcaggcaggccgactccacgagggccacaagggcctcgacgttcttgtcgcgcaccagccgtcccagatagccgttcaagaagccggcgtcccaggcgtaccccagggcctgggcgatgacgacgtcgtttatcccgccgtttgcgccgggctgatcgagcaggccggccatgttgaggtggccgccgggcacactgaaggccagtacggccagccgggcctcctcggcgctgccggtggccacggcgcggaccagatgcggttgcgccagggcgaaagacagcttggcgcaggcattgcccttgcgccagcgctcccgggagtgggcgtccagcaccgcgccagcggatgctcccggagcgctcgcaccgcgcaaatagtcgtctatccgttgcaaaacggccatgtctccggccttccacagcgttttgcattgcgcataatgcaataaaaaaagcgactcctggggcgtattgagaaaaaacggctgcaaagatcccaacacatactgacaatgttggtaatcgacataatcagaatccgaaagcagttgtttttgaaatatgtcgcaacattgctccataattattgcagtttgcacttccttgacggcatagccgcaaatacccaaacgtgtttctggctgctccagttctctcagctgttgttcgatggccgttccgcgatagcaggtcaatttggaattgatggattgcagtgatggaaaatcaatttccttcatgacgcttatcgtctgccgcatctcggaagcgctggtccagggatcgaagaaaataaaaccaggattgatggtgatgcccagatcgttgaggatggcaatggcccgtatgtgctcctcaacggtctccttcttgttatagcgatcgaggacagcctgggaaaacgattctataccaagaaaaacaccagctaggccggcggatttcaggaccttgagcagtcgcttgtcgatggctgaggatcgacacataaatccaaagcggatgcaaggcagtttgtcccgcacaagcttggcgaagcgttcggcccgcagaaaggaaggtttggagttgaggatgaaattgtcgtcaacgaaatagaagtgggcgatgttgtatgtcttatagagaaaacgcatctcatcgaccacgtcgtcgatgtcccggggccgccattttctgatgggaccggctttggggatactgcaaaaactgcatcggtacggacaaccgcgcgaagcggcgacgctggcctgggcatgcatcttgagctgccagggcaacatgtcccgggcgggccaggcaagagcgtccacatcaagggcttgctcctggacaagctccaacacgtcgccagacgcggtgtcatcaagcaaggccaacgcctgcgggacaagcgcttcgccttccccccgaaggatcgcatccgggctgtagcaagccaattcctcagtcggcagggaagaagccagaatgccgccgatcaggatcttggcccggggatggcgcttgcggacctgggcggccagggtcacgccttgcccggcgttcatggccgaaaggctcagaccgacgtaatccggcgcgacggcgtcgagcacttctggaacatggtccatggccttgtccacgaggctgcagtcccaaagcgtcacgtcatggctcttgcccagctcccgacgcacggcggcggcgacatagcccaggccgagactttcaaggtgcaactgagccccggtatcaggattgggcggcggattgaacagcaacacctttttgcgaatggccatatcccccgtcctcctggcaaggtagtttcctctccgttcccggagactccccatgctcagggcttctagtcgatagccatccaaaaacgttacgctgtcttggtctgtcccagaaaacccaaccctgccttatgctgggcgaagaccgtcgaacgcccatcctcaaaagcactcactctgctgcctcagccctgccaaccaacggaatttatgtgacaactccagtttacaccggccgaaattgtttcccgccaactgcttgcaccataaaaacatttcttaaagaaaatatttggttcagaaattgctttgtgaattgcagcacaagacagctcgccttgtgaataaaatcacttttatggcgcgtcggcaggcaacctcaggcatcaccggcaatccctgttgggataggagaaaaggagcctatgagccagaagacaggactcaccgaagacaaggtcgcactccttgtcggggccagcgtgttcatcctggccttttgcaacgtgtttgggctggacttgctcggttgggtggtcaagcccaacatctggacgtcgctggacaaggtgctttcgccggccacggccgcctacaaggcactccccggcatcgcttcgctgtgcatcacctatgtggccctgaccggcgtcctgacgctcggcgtcaaactgcttggcgcggacaccaaggaattcttcaaggccttcaccatcgtctttttcgtcaccttcatctgttacgcggccgggcactacgcccaaatcgccgccacgccggacacgctcaagaagttcaatatcccatggtccctgggtctcaccggcgaagccggcttcatcatagcgcttctggccggcatctttgtcggcaacttcatgccgggcacggccgacaagctcaaggccgcctgccgcccggaaatgttcgtgaaaatcgccatcgtcatcatgggctcggaacttggcgtcaaggccgccgacgccatgggcctggcctcttccatcatcttccggggcctttgcgccatcgtcgaggcctacctgatctactgggccgtggtctattacgtgtcgcgcaagtacttcaagttcagccgcgaatgggccgcgcccctggcctcgggcatctccatctgcggcgtgtccgccgccatcgccaccggcggcgccatccgggcccgcccggtcgtgcccatcatggtctcctcccttgttgtggtgtttacctgcgtggaaatggtcatcctgccctttgtggcccagtggtggctgaccggcgaacccatggtggccggcggctggatgggcctggccgtcaagtccgacggcggagccatcgccagcggggccatcgccgacgcgctcatccgggccaaggcgctgtccgactacggcatcaagtatcaggaaggctggatcgtcatggtgaccaccaccgtgaagatcttcatcgacgtgttcatcggcatctggtcctttatcctggcctacatctggtgcaccaagttcgagcgctgcccgggccagcgcatgcgcttctccgaagtctggaaccgtttcccccgctttgttctgggctacatcctcaccttcctcatcctgctcgtcctgtgcgccaattccgccgaaggcatgaagctcggcaagaacatggtgggcgcgctcaacgcactgcgcgtcatcttcttctccctgacctttttcaccatcggcgtggtctccaacttcaagaagctctgggaagaaggcatcggccggctggccgccgtctacgtggtctgcctgttcggcttcatcatctgggtgggccttttcatctcctggctcttcttcagcggcgtcaagccccccctggccagctaacaccccaaggagcgcatcatggaacagctcaacgacctcaagttcgccgaagaaatcaagaagatggaatatgagcccctggacgccacggaaaaacgcctggtggcctggagcctgggcatcggcgtcaccctgctcgtggttttttatttcgccagcaacgtctttttccctggagcacatgggtagttacgtagagagaagatatgcctccggcggccgggagaggctaagcccctcccggaccctccctgcaaggggtgttgggtgatgggcgggggtgttgcgtgatgtgatttgttcaacggcatgaaatgcgcgcacaaacgccttttggcgcattggtgcggacatggaggagatgatgccggcctttgccctgcgctacatcagcggtccccagctgaagctgaccgtctcggacgaacacaccgtggaagccgcgtccctggacgaggccctgcgcacccgcagcgactggcccatcgaacgcaactggcccggcacctgcgcctgggccaaaaatcccggcaccagcctgtatcatgtcgaagcctgggaaggcacgctgctggcctgacgtggtaggcttgcccttttcgtaaaacccgacgccccggccgaaccatcttcgaccggggcgttatggggctacagcgccgcgccaagcttccccgctttccgccttgtaatccacggccctttccacatcggaccgttggcgcgtagcatgatcccggacagaattggtgaagacccgccgtcaaggagtcggccatgcccaccccagccattccccgattgtcgtccgtggacaccctgcgcggcctggctatcgccgccatgatcgtggtcaacaatcccggtgaccggcgcttcgtttatccccaactgctccacgcccaatggcacgggctgaccctggccgacgtggttttcccgctctttctcttcctggtcggcgtgtgcgtcgccttggccatcgaccccgataagccccgcgacgccgaggcgcgtgcccgcctctggcgcaaaatcctcccgcgcgccgccgtgctgtttgccctggggctgggagaaaatgcctacctgcgcctgagcttcgacgaactgcgcctcccgggggtgctccagcgcatcgccgtggtctatctcgccgccgcctggctccagtctcgcctgtccagccgcgcccttgccgtcgtcggcgccgtgacgctgcttggctactggctgctgctggccgccgtgccggtgcccggccacggccacccgtccctggccatggaacccaacctccaaggctggctcgaccagctcgtccttggccggcacatctggaaattccacacgagctgggacccggagggcattctgtccaccttcccggccatcgccctggggcttatcggcgtgctggccggccgctggctgcgccggggcggcgaccggccggggcgcgccggcctgctcggactgctcctgatcgccatcggcctggcctgggacgccgttttccccctcaacaagtccctgtgcacgagttccttcgtgctccttaccggcggcctgggcctcgctatgctggctgtcgcccacgccgtcctcgacggccggcccccggccgcctgggcgcggccgctgggcatcctcggccgcaacccccttttcctctacgtcacggcctcgtttctggccgccagcctgcgccatgtgcggttcgccgacgccgccggccagaccgtcaacctgcaaaaggcgctttatctggccctgttcggtttcctgccgcccggcccttttccctccctgtgctgggggttggccatgttgacgatcatgtacctgctggccctggcccttcatgtcaggggcatcgtcatccggctctgagctcccgtccgcacctcagccccacccgccacgcctgaatgccgccgtgcggcaaataccatcgctgccgcaaggctcgccggagctttgccgccgtcgtcacagcgggatggtcggcttcccggccgtcgccgcaccgcctggcatttctcgtcaggcaggcggcggaacacgaaaaaccccgccgtcgcgggcggcgacgacggggctgaaagggcgtacatcgacgctttgcgtcagtaggccgcgatagggaagtcctccaccgtgccgggcacgccggtggtcggggtctgttcgccgccggtgagttccttgacgcgctcggagatgtagaggtcgagcatcttgaacgtcacccggccggtgcgcttgacgtcggccttgccgagcacgccttccaccagcgccttggtaaaggctccgttttgccagtccggcttttccagggaatactgccggccggtggaggcggcgaagacgatggctccgttgccggcgctggagagctcgttgatcacgccgttgacgtccgtcatgccgcgacgcgacgctcccatgatggaaccgctgtggcaggtgtccacgaaaaagagcgtcttgccggcgatgttgcggatggtcttttgcacttccatgaacggcagccccgaggcccgcagcttttccagctccacggtggtcggcaggaagtagtagtcgccgttcttgtcgttcaccccatgaccggccagaaagatcatggccacgtcgtgctgggtggtctggcgctcgatccagtccaggccgttgaggatggcttccttggtggcggcctcgtcggtgagggtccgcaccaccacgtcgctgtagagtttgcccttttgcagggccatggcggcggcgaagtcctgggcgtccttggccggataggtgagcgacagggatttgtcggcataggctccggccccgatggccaggacgtagagcttggaggccggtgcggccggcgcggcggcccggccggtccacttgagcttcaccgtggccggggccgaggggccgtttttgttctcggccaccaccgaaagcaccacatcgcgctcgggcagggccacgttgctggtgagcacgctgggctcaaggccccggccggcgagattggggcgttgctccagcacgcgtgcgccgtccaccagcacccgcacggcggtaatgtcctcgccgccggggctgcgcacggcatatttgacggccatgtccggggcggcaaatcccccgcccggagccggactgaggatttccaccaccggcggccgggcagtcagcaccgaaggcgcgcgcacatcgcccccccgggccacgttggccgcggccaaagcccggtcctcgtccagggcgcgcggcaccatgtccaccacatcgggccggtggtaggcctcgcggaagcgcgaggccggaaagaagtcggccgcgtggtccgggccgttgttgacgttccagccgatcatatcctcgccgcccggggaggcgtcgtagtagcctgtcggggtccacagcacccaacgcttgccgtcggcattggggaaataggacagcagttcgcgcccatcttccaggcggtaccagcggatggagccgtcgcccatggccgcgacgaccatgcgcccgtcgccgctgacattgaccgcccagaccgtgtccggggccggggtctgccacaacggcgcgccgtcggctccgtaggcccggacgttccaggaggtgcccaggatcagccggcggttgtccggggcgatggccagggaaaaggacgtttcgaagtccttcatcttgagcggctggccgtttagcgtcggcgtgcgccccccttcccagccggccacggtcaggccggcggcctgggttcgcggcgcggccatgtccggagtcacggcgtcgatgtgccgcaggtcgcggccgggcaaggcgaagcggtagacgcctttgcggccgcctacggcgtagcctaccgtctcgccggtgcggtcgagatagaaggcccgcaccgaggagcggtagtcctggatggccggcgagcgggtcatgccgaagctgccgtccgggcgcagcacgccccagcgcggggccacggtgccgtaggccacgccgccgtcgggcagcggacacagggccaccacggcggatttgccggtgtcgaggtcgcggtactgcacgtagtccgaaggcttgaagctgcgtatggggcagccccggtccgtgacccagcggccggcggccagaagcgacccgtcggcggcaaaggcgacggtggcgaggttgccgttgtccacgccggcgaggttgggcgcgccgaggagtcccagggtttcggcgtccaggaccgtcacggccggagtgtcggtgaagcccacggccagctggctgccgtccggggaaaaggccagggaaaagggccgcgcgccgccctgggtctgggttttggcgagcagggtcaggcccgtgtcggccacgcggtagaggcgcaccgcgccgtcgtagcaggccgtggccagatggcccttgccgtcaaaggccgcgccgtagctttcgcccttgtagtcgcggtcctgacccacaagcgccagatcggacagccgccagacgcgcaggccgtcctcgccaaggacagcggccagatatgccccgtcgcgggagatggccaagtggttgaccacgcttggcaggccggtgaggcggcgcacgagctggccggattcgcggtcgaagacatagacgctgtgggccttgtcccagccgtagccggaccagccgccgcaaaagacgtagcggccgtcggggctcatggccacgctgtagagccggccctcgtattcgtggccgatgggcggacgcagcacgcgcagttgttcgccggtcttgatgtcccagacacggcaggtcttgtcgtcggaggccgtggccagatagcggcccagcgcgtccacggcgatgcgcttgatgagcgccgtgtgcatcccggtttcgatgcgcagaatcggctcggcgggcggcgtggcggcggcgacgtgggtgaaggagaataggagaacgagaatggtgagaacgagtacgcgaaggcgcatgggcagactcctcgcccaataccgggcggcgcgcattcttctccccgccgcctgtccgcgtcaagcccgcaagggccgtgccaggaccggaaatccagccctggcgcggcatttcgtcctttcttaacgcttcatgaatttccgctcatgcgccccaggcgctcactcccctttcaccctctcgcccccccacgacactaccgccagtccccatcacccaactggggggtccgggggcctcaggcccccggcggagagggtaaggcagaggcagcgcctcttctggccgccggaggcatccccccctccccctacttcggccgggcggcctggtccaccaggtaggccatggactggtaggggatgccgccgtggaaggacaggccgatttcgcaggtgcggctgttgctgtagccggccgtgaccgtggccggcagctgcccgggcagatcggccagggcggcggcgttgagttcggggtagaaaaagccccggtcaccggcaaagccgcagcagtggatgttgcgtgggatgaccacctgcttggcgcagagtttggccagggcggcgaacttggccgacaggcccattttcaccgacgagcacgagacatgcagggccacggccgcgtccaccggggtcagatcaagatgcggcaggcagaagtcgtggatgaactccactggttcgtggagcttaagccccggttccatcttgcagcgcatggtgtagagacacgggctggcgtcgcacaggatggggatcgcgccgttgttgctcacttttcgcagcaccgtctccagctcggccgacttgcgccccgcgtcctcgtgcaggcccttggattccagcgtcaggccgcagcacagttccttcaatccctcggggaagatgacgtcgtagccggccttggccaaaacggacatgacggcggcgaaaagcccgcgctggtccgggtccagggccgaggggcccatggcccgggtggtgcagctcgggaaatagaccacctgccggcccttgccctggcgggtgttccgcagttccagacgcggcgcgcccttgggggcggtgggcgtccagtagggaaccaggccccgcgagagctttcgcaggccatgcgtcatggcggtcatggccttggtgccgagcagcttatggacgccgtgggacagatgcaagccgccgctggccagggtcgtcaccaagccgtagtggtcggccacgaaccggccgatcttgcgcgcccggtcgccggcttcccggccgcgataggttttggtgaaggagccggtgtccacggccacgggacagaccgtggcgcacaggccgtcggcggcgcaggtggccgcgccgtagtaggcgtaggcgtcatggaagtcattgaattcgcccaggtcgccggtctgtttggccaaggccatgtggcgctgcaacgcgatgcgctggcgcggcgtggtggtgacgttgcgcgaggggcagaccgattcgcagtagccgcactcgatgcagcggtcgatgatgggatcgacgggcggcatgggtttcaagtccttgagatgcacttccttgtcgtcgttgaggataacgcccgggttgaggatgccttcgggatcgaaggcggccttgaggcgttgcatgtaggcgtaggcggtgcgtccccactccatctcgacaaagggggccatgttgcggccggtgccgtgttcgcccttgagcgagccgtcgtagcggccaacgaccatggctgccacttcatccagcagcgcccggtaatgggccgtggcgtccgggtcgccgaagtccgggcagaagacaaagtggagattgccttccagggcatggccaaaaatgatgccttcggcaaagccgtggtcgcgcatgaggcgctggagttccaccgtgccctcggccagccgctcgatggggaagaccacgtcctcgatgatgacggccgtgccgggctttcgcgccccgccgaccgaggtgaaaagcccgcgccggatgttccagagcttttcgtaatcgtccttgccgtccatgaagataagcggaaagaccggctcgatgccggccacccgagacagcgcgccgtcgatggcggccagcagcccgggtttgtcggcggcgcgcacctccaccaaaatggcggcggcatcctcggacaattccttaagataggccggcatcccgggcttgtcctccaccgagcgcagcgaagcccggtccataagttccacggccgacaccgggccggccttgagcgcgatggtggcccggcaggcggcgtcgatggtcgggtagatcatgagcgacgaggccttgtggggatgctcgaccacggtgcggtaggtgacctcgctgataaaggccaaggtcccttcggagccgatgatgaggtgcagcaggatgtcgaaggggtcttcgaagtcgatgaaggcgtttaggccgtaaccggtggtgtttttgatcttgaatttgcggcggatgcgctcggccagttcggcgtcggccaggatttcggcgcgcatggcggccagctcggccaacagttccggccgggccacggcaaaggcggcccgggaggccgggtcggcggtgtccagggccgtgccgtcggcaaataccagacgcatggattccacggtcttgtagctgttttccgccgtgccgcagcacatgcccgacgaattgttggcggcgatgccgccgatcatgcaggcgctgatggaggccgggtccgggccgatcttgcggccatagggggcaagccgcacgttggcctcggccccgatgacgccgggctccaggctgatgtggcccgcgccgggatggatgcgcagcccgcgccaggcgccggccagatagaccagcacggaatcggtcagcgcctggccggacaggctggtgccggcggtgcggaaggtgacggccacgtgttcggcggcggcggtgcgaagaatccgggccacctcggcttcggtcacggccttgatgacgatcttggggatcagccgatagaagctggcgtcgtcgcccagggcgaggtttcgaaacgggccgaggaagatgcgctcggccgggatgaaggcgcttatgcggtccaagaaggctttatgggcggcgggcaggctttcggcgcggcacggctcggtcatggacggctccttggcgacgcgcggcgtcgcgggaagagggatgattggagctgttatggcacggatggggggatttgggaaccaatcgatcacccttaagctcaccgcaaaatcacattgacatatagcaacaacctgtatagatatttttttaaaaagctgatagaaacaccgcaaatcaacaaccgggactaaacaatgagcttaatacaaacgaaatcctcaaaagaagattttggttcaattataagtgatttcatcagtaacatagagagcctccacagaactctctacatcgtcatgagctttattaagcatgtcagaaagaatacaaacgacgagttcgaggaatttctctcaaagaacgccaaaagcaccaaaaaaagcgagaccgaaacggaatatagtatagaatttacaagctactacgaattcaaacaaaagttacgagatgttgagtgggtaaataggtcagggacaataataccaaagagctttgtagtctccttaatcagtgagtatgacgcctaccttggaatgattataagaagaatgtaccgcataaaacccgaagtattaaactctaaagacaaccagatttccttttccgacatcgtgacttacgactctttagaccaaataaaagagataatcattgacaaagaagttgaaaacctactgagaaatagccatcctgaacagttcaagatcattgaggcaactttttctgtcatactaaccaaagaagtagaaggttggaatgattttgtcgaactaacagaaaggaggaacttatttgtacattgcaacggcattgtcagcaagcagtacctagatacttgcaaaaaacacaaaatagaaattaacgatttaaaaaaaggtgaccccctccaagtcagcccagactatttcgacaatgcattcaatacggtccttacaattggatttatgatagggcatgttttatggagaaagttccagccagaggagtcacaagatgccgacaaacatttaatttctgttgtttattcacttttaacatcaaaacactacagcgccactataactctctgtaaatttgcaataaaatgcataggtaaaaaattttcatcagaggaaacacgtagaattattgtaataaattatgcaatagccttaaaattttcatctaagaaagaggagatggaaaaactactcaacgaaaatgactggtcggcttccagcgaaaaatttaaacttgctgttcttgtattaaacgacaacaatacagaggccgccacaaccatgcgtaaaataggttgcaacggtgaagtaacaaaagctgactacaacaactggcctttgtttgaaaattttagagagacagagattttcaaaacaacatatcttgaagtattcaatgaggaaagcatgtccatatcggaagacatcaaaaacgaacaagaaaactcaaaaacaaattgtcgcgaagcacattctgcacccacaacaacaaacaaacccaagcggcaccacaaacgatcagccaaaaaacacaaaaaaagataatcacgcaacaacagccatagcaactttaacaaagacaatacgaaaaacaagcggggcgtccgtcgccgggcgccccgcaaaaaaacagtcagcccactgacggccgggttacatcttccccaccacctcgataagcacactcgtcaccttctcggcgttttccttgaagatcgtcacgatctcctcccaggagacgggcggctcgtcggtcttccagcagtcgtagtccgtgctcatggccaccgatgcgtagggaagcccggcctccacggccagggcgcattccgtggccacgctcatgttgatgacgtccgcgccccaggcccggaacatgttcgattcggcgcgggtggaaaaacgcggcccttcgatggtgaccaccgtgcccttgtcgtggtggcagtagccgaacttgcggcaggcgtcgatgagcagctggcgcaacggctcggaaaacgggtcggccatgggcgtgtgggccggattgtgcggctcgaaacggtcgtggaaggtgagcgcacgacgccgggtgaagtcgatgaactggtcgaggatgaccagatcgccgcgcccgatctcggcccgcagcgaccccaccgccgtggtggagatgacggcggcgcagccgaccgcgcgcaaggcgtggatgttggcccggtagttgacgtgggtgggcgtggccgtatgcgaccggccatggcgggccaaaagcaccacgtccttgccggcgatccggccctggcgcagggtcgaattgggcgcgccgtaaggggtgtccacctcgatgtcggacggattttccaggatattggggtcgtccaggccgctgccgccgataatgccgatcttcatgccgtttttctccgactggatagtcaactaagaacgagccagggttccagaggctcccgggccagggaagagcgcctcgggcgctttgtccagacaaccgccgcgtcggtacgaaatccgcccttaggcgatctgcaaaatgctctcgcagccgtaggaacgcagctgttccttgccgtttaaaaattccagctcgatgaccacgccgatgccgacgatgtccgcgccgaaatgctccacgagatcgatgacaccggacagcgtgccgcccgtggccaacaagtcatcgatgaccagcactttctcgtcacgaagcagcgcgtcctcgtgcatgcacagggtgtcggagccgtattccaggtcataggagacggaaaccgtcttgtacggcagcttgccgggcttgcgcaccggcacgaagcctaggcccatcttgtaggccagcgccgcgccgaaaatgaagccgcgcgcctcggcggccacgattttcgtggccccggaatcggcgaagcgctcggccaaaaggtcgatggcccggcggaacccgtccggatcgcccagaagcggcgtgatgtcgaaaaagaggatgccttccttgggataatccgggatatcgcgaataagttgacgcaggtccatgggcctctccttggaaattcagtcaggtaaccgcagtcgcataggcaattttgcgccatccggtcaagccgggcttggcctgcccgccgccctgggttaagggatgcggccatggaaaacgccactgcccccctgccctgcgatgtcctggtcacggccgccgttgtggtcacccaaaacgatgcccgcgaggttttgcgcgacgctgctctcgccataaccgacggccgggtctcggccgttgggccgcgcgcgcagctggccgctgtctacgccccggccgaaacccttgatctgggtgaagccatggtgctgccggggctgataaacagccacggccacgccgccatgaccctgtttcggggcctgtgcgacgatgaaacgctctcggtgtggctaagccagcacatctggccagccgaggccaagctcacggccgaggccgtacgccagggcacactgctcgcctgcgccgaaatgctggcctcgggcacgacctgctttctcgacgcctatttctacaacgacgccgccgtggccgccgccgaagcggccggcatccggggcgtgatctgccagggcgttttcgacatggaaagcgccggcttcaagtccgccaacgcctccctggccgaaggcgcggccctggccgaccaactcgccggcaacgaccggctgcgcgccgccgtgtttccccacgccgtctatacctgccgccgcgacaccctggagcgctgcgccgccctggcccgggagcgcggcttgctcctgtccacccacgccgccgagacagcccgggaaaacgacgattgcctcaacgccaacggcaagcgcgtcattccgtatttgcaggagctggggatgctctcgccgcacacgctgctcgcccacggcgtggccttaaatgaaagcgacatcgcgctcctggccgcctcgggcacgagcgtgtcccactgtcccaagagcaacatgaagctcgccagcggcattgcgcccgtacaggccctgcgccgggccggcgtgacggttggcctggggacagacggcccggccagtaacaatgccctgaacctcttttcggaaatgagcttcgccgcgctcctgcaaaaggtgggcaccggcgaccccacagcccttgaggccggcgcggtcctggacatggccacccgcgacggcgccgccgccctgggctggcccgaactgggacgtctcgcgcccggcgcgccggccgatctgtgcgccctggacctgacgcgcccggccctgcgccccggcctggacccggtgtccgacacggtctacgcggccagcggcggcgaggttgtcctcaccatggtcgccggccgggttctctaccacgacggcgcgtttttgacctttgactacgaaaagctgcgccgcgacgtggccgatacggccgcccggctgacggggcggtagcggcagcccctgaaaagtcccttgacagccccgcccggctccgtaataaaggctggctttgcgccgcaactattcccgcgccccatcccgcgcggtccggaggttatcccatgtcccaggtcatcaccgtcaatggcgtcgaatgccatcccatcgtggagaagtgcgagggctgcgatcgcaccatggagcaggatggggtcaaatactgcaagagctatcccctgcccgagcgtaagtgggcccagaaggtctgcaacttcgccacccacatgaagctcgaagtcgacaagggcggcaaggtcaacatcaaccccctcaaggcctccaagcgcgccgcccgcggtcgctaggccccgctctttctctatcacgcccagccgggaggtcttgcgcctcccggctttttgcgttgcgtccggtttgccaagcgtccgccgaccggctacattgccggctttggcgacttctccacccataagcccggagcctctatgctagacgacttgctggcccatatcgacggcgaacgcgaggccgtcatcgacctgcaacgcgaattgaccgccatccccgccctgggccccgacaacggcggccccggcgaacgcgaaaaagccgaccgcctcaaagtcctgctggccggcatgggcttccccgaagtccgcgaaataaacgctcccgatccccgcgtgccctgcggccaccggcccaacctcgccgtggtcatgcccggggccgacacctcgcgcaccttctgggtcatctcccacctcgacatcgtgccgcccggcgaccgcgccctgtggaagaacgatccctacacgctgtccgtcgatggcgacctcgtgtacgggcgcggtgtcgaggacaaccagcaggccgtggtcagctccatcctgctcggtcgggccattgccgccaaaaaactgctgccgcccatgaactacgggatgctgttcgtggccgacgaagaaaccggcagcaagtacggcctggactacgtggccgcccaccacgacgggcttttttccaaggacgacctcttcctcgtgcccgacttcggtctgcccaccagcgaaatggtggaagtggccgaaaaaagcatgctctggctcaaggtcatcgtcgaaggccgccagtgccacgcctccaccccggccgaaggcgtcaacaccctggccgccgcttcgctttttatcctcaagattcccaagctctacgacaagttcggcgacaaggacccgctgttccatccggccaactccaccttcgagccaaccaagaaagaagccaacgtcgaaaacatcaacaccatccccggccgcgacgtcttctacgtcgactgccgcgtgctgccccattacaacctcgacgacgtcttggccgccatcgcgggctacggcaaagaagttgaggaagcctgcggcgtcaccgtcagctacgagatcgtgcaaaaggagcaagccgcgccagccaccgacgtctcggccaccatcgtcacccgggtcatggacggcatccggcaggtctacggagccgaccccaaacccatgggcatcggcggcggcaccgtcgccgcctacctgcgccgccggggctacccggccgttgtctgggccaccctggaacacaacgcccatcagcccaacgaacgttccagcatcgccaagaccatcggcgacgccaaggtcatggcgcgggtgttatatagttaagtgagagaagagaggaagatgcctccggcggccaggagaggctctgcctctcctggacctctccgccgggggcctgaggcccccggaccccccacatgggtttctgggaaagcgttactgtttcggcgggtggagaaagggatgaatatcaagcgcgcttggaaaaaactcctcatggagcagtgccgccggcccggcggcattcttggcgaatacatcggccggcgcatgaaccgcagccactacgccctgaccacctggggcctgtcccaggtggacgtcgccccggaccaggacatcctcgacatcggctgcggcggcggccgcaccctggcccggctggccgaactcgccccgcgaggccgcatctgcggcgtcgacgcctcgcccaaaagcgtgaccctgtccctgcgccacaacgcccaggccgtggcctcgggccgcatggaaatccgccaggcctcggtttcggccctgccctaccgcgattccacgtttcacttggtcaccgccgtggagacgcattacttctggcccgacctggtcgccgacctggccgaagtgcggcgggtgctgcgcccgggctgccggttcctgcttcttgccgaggtctacgacacgccgcgtttcgacgcccgcaaccgcaaatggctggaactcgtgcccatgacctatttgacgccggctcggttccgggaactgttcgagaccgccggctttgtagacgtcgctgtccgcgaggaagccgaccagggctggctgtgctgcctgggccgcaagcccgacacagcctagagccgcctgaggccgccctttccgttaacgccgatctgaccatgccccccattttttgcccattccaccccttgcaaggtggtccgggggagattatcccccccggcggggcgtcggggcagcgccccgacatgctctttccctttccctacgccggaggcgcgtgacttccatgacgttcgacatcatcgtgatcggggccggacacgccggctgcgaggcggccatggccgccgccaggctcggccataagaccctgcttctcacccagaacgtggaccgcatcggccacctgtcctgcaatccggccatcggcgggctggccaaggggcacatggtccgcgagatcgacgcccttggcggcatgatgggcctgtgggccgacgccgccggcatccagttccgcacgttaaacaccagcaaaggtccggccgtgcgcgccacccgcgcccagatcgaccgcgacgagtatatgcgggtggtcaagcgcgacgtgtttgcccaggaaaacctcaccgtgcgccaggacagcgccgaggacatcctggccgaggccgggcgtgtcagcggcctgcgcgtcgcctcgggcgaaatctttgccacccgggccgtcatcgtcaccaccggcacgtttctgggcgggcttatccacatcggtctgacccagctgcgcgggggccgcctgggcgatccgccttccgacggcttgcctgccagcctgcgccgccatgggctgatctttggccgcctcaagaccggcaccaccccgcgcctgctggccaagagcatcgacttttccgtgaccgtgccccagcccggcgacacgccgccgccggggttcagcttccacggccccgggccggtgctgccccaggttccctgctatcttacccacaccaacgcccgcacccacgaggccatccgggccggtttcgagcgttcgcccctttttaccggcgtcatccaggggaccggcgcgcgctactgcccctcggtggaagacaaggtggcccggtttcccgagcgcgaccgccatcatgtgttcctggagcccgaaggcctggaaagcccggagatctaccccaacggcatctccaccagcctgcccatcgagacccaaaaggccatgatcgccaccatcccgggcctggaaaacgcggtcatcgtgcgcccgggctacgccatcgaatacgactacgccgacccggtgcagctgtccccgaccctggaaaccaaggccctgccgggactgtacttggccggccagataaacggcacctccggctacgaggaggccgccgcccagggcctgtgggcctcgctcaacgcctgtctggcgctttccggccgtccgccgtttctcctgcgccgcgatcaggcctacatggccgtcctggtcgatgacctcgttaccaaggggaccagcgaaccctaccgcatgttcacctcccgggccgagcatcggctgctcttgcgcgagggcaacgccgacgcccggctgaccgccctgggtcgggagatcggcttggtaggcgaggcccaatgggcgcgttaccaggccaaggaagcgtccatcgcccaggccctggccgggctggccgaacgtcgggtgcggcccggagactgcgacgacgcggcctgggaggcccttggcggcaagccggccgagcgcagcctgcgcctggacgaactcctgcgtcgcccggccgtcacgctgcctgatctgttccgtttctggcccgaactggccgaactgccggctgaggcggccgtggaagccgagacccgcgtcaaatatgacgggtacttgaagcgccaggaggagctggccggccgggccggccgccatgagggcgtggagttgccccaggacctcgactacgccgccgtggccgggctgtcccgggaagtggtggaaaagctcatccgggtggccccgcgcagcctgggccaggcctcgcgcatctcgggcgtcaccccggcggcggtgtcctgtctggaaatccatctcaaaaagctgtccagacaggcctaaaagccccttgtgcccgcccgggcgatggcttatgaccgattcatggcggaattctgggggtttgcccaccttccggcttttttaagcctctttgaccccggttggtgggatcggatgctcgacgccaccaacaccggccatgcctcgcccgaggccctgctcatcatggccatgattttcgggacctttttcacactgatcggcgtcggcgcgttcgtgaagaccaaataccggccttcggacgtgcgcccaaccacctggatcaccaagccggccgaggtccgggccctggtggaaacggccctgacccagcgcagcaaggtccgggtgagctttgtgcgcgacgatcccggcgcgcgcatgaccgacgccgccatcgtcgccgcctcgccgggacgcggcatcgaactcgaaatgacgtcgctggtgcgggccaacccgacctggatcggcaagctcgtggcctgcgattttcgcctgcgcatcgacccccaccgcgatctgcacagcttctacaacttcgttgcccccatcctggccatcggcaaggccggcgacaacttcattcacatgaccgtggactggccggcccgcctggaactggagcaaaagcgcgggttcttgcgggtggagccgccgcaaaacgtcattctcgaactggaattgtggcacgaatccaccatcaagaacaaccggggccgctttgccgacccggccacctggggggaaccgcttttgcgctatgaccccaagttcgacacgcccgacattgaactgcgcaacatttccggcggcggcctgcgcctggaggtccagcacgaggcctaccgccgggggcatcgcctgttcgagccgacctcgcgcttcatcgcccggctgcttttggccgagccggaaatcggccagcccgtggagttcaatctggctctgcgcctgcagaatatctacggcgatcccaaggccctgggcatcgtcggcgtgggctttcacatcacgagctttgccgtgcccggcgacacgcccggcgagccgctgtcctggaaaaccgccgccgccggcgtgccggccctggacgactgggcctaccgccgccatctggccatctaccgccaacgcggcgaatagccccatggacgaacgccaagatcgttgttagtatttttgttccgctatccgggcttgtcacggaaacgacgcaattcccggagtacttcgcggaaaaacgccgcatgacggcgcgccccgcttaggaggatcaggttggacgacgattccgatggtcggttttggaatgccctgaccaaatttttccgccaaaaaagcatttcccttgaagagttgatccaggaagcccgggcggagggttccatcatcccggaagacgcctccatgctgctcaacatcctgcggctggaaagcaagcaggtgtcggacatcatggtgccgcgcccggacatcgtctgcgccgagatcgacgacggcctggacgccgtgtgcgcgctgatcaaaacccacggccactcccgcatcccggtctacgaaggcaaccgcgacaacatcctgggcgtgctctacgccaaggacatcctcagcaacatgctgccggtctgcggcgaaacgcccgatctgcgcgccatcatgcgcgaggcgctgtttgtcccggagacgctggaccttaaaaagatgctcctggaatttcgcagccagaaaaagcacatggccgtggccctggacgaatacggcggcacgtcggggctgctcaccctggaagacgtgctggaagagatcgtcggcgaaatcgaggacgaacacgacccgagcaagcccgaggagatccgggagctgcggcctggcgtccatcaggtttccggccgggccatgctcgaagacatcaacaccgccctgggcctgtccctggagtcggagcaagtggagaccatcggcggcttccttaccgaattggccggccgcgtgccccggcagggcgacgccttcaccctggacggacggcgcttcaccgtccgcgaggccgatcgccgccagatccgctccatcgtcatcgagccggccgaggcctaactgtcgctaatcacttttcccgtcgagggggtccggggggatcacccccccggccgccggaggctttccccctgccgcctatcctcaaatccccggaagtgacgccgtgatccttgccgcttttcttgccgtgtgcggggcctggttcggcctggccaatcccgtcgcccgcctgccgctactcatgctgttgctgccggccggtttggcctacctcgcctgccgggccgaaaccgccaggcaagccgccaaatgggcctactggaccggcgcgctggccgccgccggcaatctctattggacctgcctgcctgttcacgacttcggcggcatgccctgggtgctggccacgcccgtgccggtgctcatgggcctggttcttggcgcgtacgccgccgccctggccctggcctggcgctttggcgcggcaaggcttccggcttggctgtttgtgccctacgccggggctgcctggaccgtcatggaaatgttgcggggcacgcttttcaccggctttccctggctcaccctggccggagctttttcgccctggcccatggccatccagggcgcggcctacctcggggcttatggcctctcgggcctgctcgccgccctggccgccgccccggccgtctacgggcttttctcccgtccgaccctggccgttatcctcattgcggccggattggcctttctcggcaaccgccggctggccgaccccgtgcccaagattgccgccgcccatgtgaccatcgtccagggcaacgtggaccagagccgcaaatgggccccggaggccgaggaagagacggtcgaaaagtacattgaactgtccaggggcgccctgtccgatgcgccttccgacctccttatctggcccgagacctccatgccgtttttcttccaggatggcggccatctcgcccagcgcgtgcgcgacttcgtcgcctcggccggagtgcccctggtctttggcgcgccggcctatgagcgcaccctgggtgggcacgtgctttataaccgggccttcctgctggccccggacggcgtgaccgccggctacgacaaggaacatctcgtcccctttggcgaatacgtgcctctggggcagtacctgaccttcatcggcaagctggtcgagggcgtgggcgacttcaaacccggcgcgtcggccgctcccctacgtcagggcgaccttgccctgggaacgctcatttgctatgaagcaatctttcccgaactcgctcaaaaacgggtggaagccggggccaacgtcctggtcaacatctccaacgacgcctggttcggcgatacggcggctccccggcagcatctcgatctggcgctgctgcgggccgtcgaacaaggacgggcgctcatccgaggcaccaacacgggcatttccgccgtgatcgacccccgggggcgcgtcatggcccagggcggccttttcacggccctggccctgccatgcccggagacgcccatcgtgtcggaaacgacctggtatcaccgctgctacggcctgatcacctggggcctgccggccctgttcgtgctcctggggctggccgcttgcttaaggcccgttcggtcccgcgaccgccgccccggcgggctgaccctttaaccccaagcgactgctcacgacatgctgcaatattcggaactgcgcacccagggcgccgagcttttggaaaaattcgaaggattctggaggcgtctttgacctggacaaaagccgccagcgtcttgaactcatcgaagccgaactgtcccagcccggcgcttgggataatcccgagcgtctgaccccgattcttcgggaaaaaagcgccctggccaccaaggtcgccgacggcgagcgtctgctggccgcccgggccgaccttgaggaatggctcggcatggccaaggacgacggcagcccggagatcctcgacgccctggccgaacagatcgacacgcttcgctccgaactggccgacgccgaactggccgcctttttcggccccgaggacaacgccgacgccatccttgaaatccaccccggagccggcggcaccgaggcccaggactgggccgagatgctgctgcgcatgtaccgccgctgggccgaacgcaagcgtttcgacgtcaagatgctcgacttcctgcccggcgacgaagccggcgtcaaaagcgtcaccctgcaaatttccggcccttacgcctacggcctgctggccgtggaaaaaggcatccaccggttgatccgcatctcgcccttcgactcttcgggccgacgccacacctcctttgcctcggtggacgtctaccccgacgccggcgtggacatcgacatcgaggtgaaggaagacgatctgcgggtggacgtgttccgggcgtcggggccgggcggccagcacgtcaacaagacgtcctcggccatccgcatcacccacctgcccaccaacatcgtggtgcagtgccaaaacgagaagtcgcagcaccgcaaccgtgagacggccatgaaggtgctcaaggccaggctttatgacctggagctcaaaaagcttgaggccgagaagcaggaaagctacgaatccaaaaacgccatcggtttcggatcccagataaggacctacaccatgcagccataccgactggtcaaggaccatcgcaccggcgtggacgccggcgacgtcgaagcggtgttggacggcgacctggacaagttcattcgcggcttcctcctggcgtcgggcgatgactcccgcaaatagcgacggctgttcgccggacttcccggacgaggccctggccgccgagctggacgagctgcgccagttgctcgacggaacggacaagccggcttgcgccgaggaaggtgaagggctggtcatcatgcgcttgtgctcggggctgacgcttcaggaatgggaggggcttggcgcgcggcgcgacctgcgcgactggatggccctgcccatcaccgccaacccgttcccttatctcacgcgtatccagcagacgctcaaggaactggtctttctctccgaacacgatcccctgaccaagcttcacaaccggggcgcgttcgagcgtatcctgtccgccgaactcatccgctcctcgcgctcgggccagcccctggccctggtgctgctcgacctcgacaatttcaaaacggtcaacgacacctacggccacccctgcggcgaccgggtgctggaaaccatgggcgcgcttttggccgccgaaaagcgcacctacgactacgccgcccgggtcggcggcgaggaattcgccctgatcctgcctggcgtcggcatggtccgggccgaaggcatcgtcgagcgcctcatcgaatcggcccgcacgcttcgggtggtctgcgacggtgtggacacgcccctttgcgtgaccctttccgccggcatcgcctgcaccaagggcaaagtggccatcggctgggagaagctctacgccatggccgacgaggccctctatgcggccaaagcggcgggcaaggaccgcgtccgctgcgcccccatcgccgacctgaccggaacccctgaaaaaaccctggtgcgggccgatgaaaagcgctttcttttcaccggcacgaccaaaggatgatacggcgtatgcccgaagcctcaaatcccaacgccacgctgtcggtggccattttaagcggcaagggcggggtcgggaaatccaacctgacgctgaacctcagctatgccctgtttcgcgccggccaccgggtgctgctcatggacttcgacgtgggcctggccaacgtcgacgtgctgctcggcctgtcgccggaaaaaaatctccaggacctgtttcgcccggaagtgaccgctgccgaggtcatggtgcctgtcgagcccggcggtttcgacttcctgccggcggccagcggcgtgcccgagctgctggagatggacgacgacatgcgcgaggtgctgttccaaaagcttaacggcgtgtttggcggctacgactacctcatgctcgacctcggggccggcatctcgcccacggtgctgtccgtggccgccatgagccagatgcgggtgctggtcgtcactccggaaccgacttcgctcaccgactcctacgccgtcatcaaggtgctccacacccagtacggcatttccgacttccacgtgctggtcaaccaagtggagcgggtctcggacacccaggccacctttgcccggctgtcggcggcttgcagccatttcctgggcttcgaaccccagctcatcggcggcgtgcgtcatgaccaggccctgcccgacgccgtgcgccgccagattcccctgctgcgccacgcccccaaaagccccgccgccctggacatcgtcagcggcgcggtgcggctgcaccgggtgcgccagcagcgccacgacgaactgctcggcgggccggtgctgggaaaaattccaacgattcgcaagtaggacttgacgggggaccgttgttttcggcaatggtatgaaatagatggacgattgcactccgccagcttggggaggcgtccggccaaccgtcaacagcgcgaggaccacgcgatgaacaaaagcgaactcatcaagaccctggccgagaccaaggacctgcacatcgacgaagccgccgacatcgtcaacgcctttgtcgattccgtcaaacaggcgcttatcaacgaagaccgcgtggaaatccggggattcggcagcttcaagatcaagggctacaagggctacaccggccgcaatcccaagtccggcgacgtcgtcaccgtggcgcccaagaagcttcccttcttccgccccggcaaggaactcaaggaatatctcaacaagtagcacccatgcgcaccctgaccaccttgctgctggtcctggccgtcacggctatgaccacggcggcggcgttggccgctgaaccggcgctgaccatcctctacgccggcaatacctacggctatttcgacccctgccccacctgcggcccgcaaaagctcggcggactggcccggcgggccagcgcaatcgacacggcccgagcttccggcaaaaccctggccatagccggaccctgggaattcgctcccgaagtctcggccgccccgcccgagccggccaagctcccggccgtggccaaggcccacgaaaaacttcgctatgacgccctggccgtcacaccccaggaagcggccatcctgtcggccaacaaggccgccctgcccaagggggccgtgctgcttggcgacgcgcccaccacggccgtcgtcaacgtcggcggcaagcaggtcgggttggtctttttccccatgccgaaagacatcagcgccgctgtgccggacaaactcatagacgccgcggccaaggccgccgtcgaactgcgcggcaaggtcgccctggtggtgggcgtgagcccctggggagcgcttgacgaagaagccttcatcaacgccaagtccggcgcggtggatgtgctgcttggcagcggcggcggctcgggctttgcttcgcgcacctccaaggacggccgtaccctgtggacccgggcctacatcaagggcaagaccataaaccgcctggatctggccgccctgccgggcgcgccgggatttagctggaaaatcggcgagaacttcacggccaaggtcgaccccctggacgagaacttcccgcaagatccggctgtcgaggccattctcaagtaatttcggccgtcgcctcttccgggcggcggcctttaacctttcgaggctaaccgtgtacaccgcattgcgccgcctgctggctgcggcgttgttcctggccctgacggtcctctacggccttccgacccaggcccaggaaccggcactgaccatcgtcctgtccggcaacacctacggcaactacgagccctgcccgtcctgaggcggtaagctcgtcggcgggctggcccggagggccgccttcatcgaatcgctgcgcagcgccgcgcttggcaaggaccgtaccctggtcattgccgccccttttgaaatcctgtccgacggcccggagaaaaagcccgagccgcgccgcctgccggccatcagccaggccatggcgcgccttcgctacgacgccggggccatcctgcctagcgaagccgagtatctccaaagcgtcggtgcgcccatcccggccggcttcacggttcttggcgacaagccggccaccgctgtcatcgacaagggcggggtcaaggtgggcatcgtctttttcccggccccggccgatctgaccaaacccacgcccccggccgtgggcgacgccgtggccgaggcggccaggaagctgcggccatcggcggctctggtcatcggcgtcagcggcattggcatgctcgacgaggaagccttcctggccgcccaccccgacgccctggacgtgctgctgggcagcggccttaacgccggcacggccggacggcccggccccggcggcaagacgcttttcgcccgggcctatacccgaggcaagaccgtcaaccgcctggacctccagcaactgccaggcggcccggattttgcctggaagctgggcgagaacttcaaggccgaggtggtgaacctcgacgaggcctacccggccgatcccgagatcaagaagctgttcgaatagccaggcgtcgccgccgcgcgccgcctggcaaggcaatacgccccgccctccccgcagtccggctgcgatgagggcggggcgttttcacgtcgtaggggaggcctcgtctcacgaccacaaaaagtacatggggattccgcggacaacaggctaaaccccttaatatttcttaaaaaaccatcgtatttgttaagggacgcgactcgagaagcgtcaacggttggctggagaggctgtcgcctgtccgttgtcgtgggtaaggcgcaagggcacgaaatggcgccagacgaccaccaagggcgtcccaggggccttcacagaaaccggcgacaatgagggtgggctacccccaggccggcggctgggagacgacgcgcgcgtaggcgtcaagaacgatgcgggcggtggtgtcccaggaaaaaagcccggcccgggccagggatttttcccgcagcgtcgccgccattgccgtatcagcgctcagcgcggccatggcccgggccaacccggccacgtctaggggatcgaccagcacggccgcgtccccggccacttccggcaatgatgtggcgtcggcgcagatgaccgccgcgccaaggctcatggcctccagcaccggcaagccgaagccctcgaacagggacggatagaggaaggcgtggcacgaggcgtagagccaggccagttcggcgtcggacacgtagcccgtgaagacgagatgctcggcaatgcccagttcagccgccgtgcgggccagatcgtccatgagccagcccttgccgccggccaggaccaggggcatggtcccgccggtctcccgccgccaggcggcgtaggcggcgaaaagccgctcatggttttttcgcggctcgatggtgcccacgcacagccaaaaggaacccgtttccattccgtccaaggcggccggccgggtccgggggctcgacaggccaaagcggctggccagcggggccaccaccgtgcgttcccggggatagcgcggaaaaaccttcaagaagtgcttgagggaatatttcgagatcgagacgatgcaatccgcccggatcgccgccccaaagacgccgtcgaaacagccggtgcggttgccctctgttgtccaggccggctcgaccagaaacgacaggtcataaagcgtgtagaccagccgcgcccgggtcaggcccgttgggcaaaaaaagttgttggcgtggacaatgtctggttgccccaggcgggcctcaaaatcggccggcggctggcggaagaagcgtttctggtcccaaaaacggccaaaggccggcccctggcggaatcggccgccagcggggcgcaaacaagccccggggcgcggctcgcggaaaaagtcgccccaggccggatagagcacatagtcgttggccgtatccacatgggccagggaactcaacaacccggccgcgaaatagccgcagccggccttgcccgaaccggtctgggagacgtcgaagccgatcctcatgccgggccgcctccggggcggataaggccccgcgtcaaccaggaagcgacggtgcgccataaccccggcgagatcgaacggttccagcgccaggatgcccccagcgacgccagggccacggccggggtaaagagccggctgcccgttaaaccccactgctcttccaccaggacatgggcgtagttgcacagccaccggtccggggtcgtgccgaaggtgtggcgcagcatgtcgttgatctcggcgtggactttcagccgtgccccggaggtcttggtctgggggtagaaccgcgacccggccagcttgcgcggcaggtagcggaagaccgccccgcccttggccagtcgcagccagaattcgtagtccagggtatactgccagcgcaggtccaggacgccgaagcgctccacggcccggcggcgcacgaaggcagccggctggcagatgatgcagcgctccttgaggcgcgtgagatcaaaaggctgcaccgggtaggcctcgatgaaggcgtcgtggacatcgatatggtcgccgtcgccgtaaaccacatccacgtcgggatgttcttcaaacacctcaagcactgcttgtagcgcgccgggcatatacacatcgtcggaattgagccaggcaatgacctcgccggttgtggcggcaatgcccttgttgacagcgtcgggctggcccttgtcgcgctccgaccggaaggtcagacggtcgccgtagctttccagcacggccacggtctcgtcggtgctgccgccgtccatgaccacgtattcaaggtcggccacaccctgggacagcacgctgtcgatggtgcggccaataaattgcccctggttgtaggagggcgtgacggcggcgacgctaagcttgcccatggtcgcctccggcgtaacgcagatccacgtcgcgcgcgccgtcggttaggcgcagctcttcgcagcgcgccgacagccgtcgccggtccgcgcccggcccctggccgtcgccccggcgcgcgccgtcgaacaggaattccacgcagccgccggccggcggcaggtcgagggaaaacgccgcccggccgccgcgcttgagcgtttgcgccttgccgaccgcccggccggccaccagggccgtcaccgtcacccgggccgccggggcctcggccggcagggcgaatgtcgcccgcagccactggcgatgggccgccgggccataggccgcgaaaagcctcgtcccgcaccaaccgtcggcccacagcccgcgcacggccgtgctctgggacaccggccgggccagcacgtcctcgaaaacagccaggtactttcgggccatgtcctcggggccgccgaaggcggccagtcgctcccgacccttggccacaagcccttcgaccagcccgggttcgtccaggagccggctcaaggcggcgacaatcgtatcgggccgcttgggatcgaaatagagcgccgcatcgccgccgacctcgggcaggctggtcacgtcggaacagacaatcggcgtgcccacggccatggcctcgaccagcggcatcccgaagccctcgaagagcgaggggaaaaccaaagcagccgcgccggtcataagcgccgaaagctcctcatcggacacgtagccggcaaaagtcacccgctcggccaatcccaggcgcgccgccgcctgaccgagttcggcccgaagcccggtgtccgccccggtcaataccaaccggacgtcgtcggtccggccggctgccaacatgccgaaagcggtcagcaacatgcggtggtttttatgcggccagtaattggccggataaaggaaatagcgcgcttctcccagctccagacgcgcccgggcggccgccacggcctcgggggcggcgcgcatcagccggcgcggcagggagatatgcaccgtggccgtgcgcccgggcggcacattgccctgggccagcacggactggcgggtgaattccgagatgcacaccagccgctcggccagccgggcggcggtcaagaatgtgcgctcccgcccggcctcgtcatcgggcgcgaaaaactgcggataggcggcgtactgcagatcatagaccaccgacacggccggcacgtcgggatggtggaaatagggcatggtaaacgggcagaaatacaggtccacgggctggccgcgccagtgggccaagccgcgcagccgccccagggtcgaggcccggacccgctcgacgtttggcgcgtcgaggtgggagagctcctcgtgggcggcgtcggcggtcaggcacacgaagcgccagtccggccgcatgtcgcacaaggcgtggagcagcaggatagtcatgagcttggccccgccgttgtcgcccccgggcagcaccggggtgagatcgaccagcacgagcgccttgtccgtggccttggcggccgggacggcccggcggccgcgctccttgagcacgtatttgacggccttgttccagaaccaggccacccgaccgactcgcaggagcgccttgttgacgaactggggcagccgcccctcggacacccagcccgaggccatctcgcgcaccacgccttccaggcccccgatcaccggagcctcgccgccgcacagccgatccgcctcggcctcggccgcctcggcccggcgggccagatcgagcatggacagggtcagccggccgtccggctgggcgcaaagcgccttttccacagcagcgtcgtcgtggtcggccagggcttccttgccggccagaaacagcatgtcgtaagggaaaagcgccgtgccaaagcgcagatgcggcaacccggcggccgtgaaaagcgcccgcgccgctgactggctgaaaagatagaggtgttcggccggcagcaacatgcgcgtaaacggatcggcctcggccaaaagccgctcatggctggccccggccggaaagcgtggggtctgcaccagcaccaccccgcccggagcaagcagctcggccacccgccgcagcaaccccaccggatcgggcagatgctccaacacgtccatgaggaccacagccgaaaggctccccggagcaatggcctgctcctccagtggcccggccaaaacttctatgccgaaggtttccccggccaaccgggccaccgagccgtcaagctccagccccctggcccgaaacccggcccgcgacaagagcgccgtgaagccgccgtgggcacaacccagctccaacgtctcgcccggcggcagacaggccgaaagcagaaacttgagccagcccaggcagcgctcgggcaaatcgcgccgggcccggacctcaatggacggctggcccaggtcggccacctgatggtcgtaccagtagtcccggccgtagcgctcgccgtcctcgacccgcgacaccaaggtgccgcagcccgggcacagcatgtactcggccccgaaaggctccaacccgcccatcccgcaccaacactgccgcatatgaaaactcccaaactgggggaggaaacccctttttgaaaaaaggggtttcctcccccagacccccaccttccccaaaaactttccaagggggtgggttaactattgtccgtgttcgttggtcccgtcgcgctggggaattacggagcggactcgccgccatacaggcgcagggtcgcctggccgggcagattggccacgccgtgatgggtgagctgcacgggcgtggtgtcgcggctgcgaaacgtcaccaggaaatccccggcccgggtcacgatggagatgaccgtggtccggccctccagttcttcgtgggacaggctggcccggcgctcgaaatcgctcacggacagggccgaaaagccgagattgaaggtgtattcgcccggagccagatcgagcttgagatcaaaacgcgcccgcaacaccgtgccgttcggcgtggccagggcgtggtcgcagtcgaattgcagggtgtttttgccgaaaacgatcacgcgcttgtcgtttatcagttccaccccggccacggccacttccaggtcgtggcgcacggcgtagcggcaaaaaatcgagaccgtctcgccctgctcgaagctgcggcagggttggcccgaggcgtcgcacacggccacgtgggtgcagccggcccagtcgttttcggccacggccgcgccggaaagatcaaggaaggcgtcctgggccggccagccgtcgccgtcctggccttcgggcggcaggtcgagatttcgcgacgcgtcgccaagggatgtcggcacgtagtcgccgccgccgaccatgtagcgtttgaccgccgccgccgcgtcgccgagatagcccacccggccgtgttcgaggagcagtccccgccggcagaactgggccacgtcgttcatggcgtgggaaacgagcaccaccaccgtgccttgagccaggagtccttccaggcgcttgtagcatttctggcggaaaaagacgtcgcccacggccaaggcctcgtcgatgataaggacgtccggggtgaggctcgtggtcacggcaaaggccaggcgcaagaacatgccgctggaataggtgcgcaccggctggtcgaagtgcggcccgatgtcggcaaaggccgcgatgtcgtccatgcgggccagggcctcggcccgggggatgcccagcacggcggcgttgacaaagacgttttgccggccggtaaattccggcttaaacccggaaccgagttccagaagcgccgtggtgcgctcgggcaggatggcctcgccgccggtcggctccagcacgccggccaggatttgcagcagggtcgatttgccggctccgttcttgccgatgatgccaaaggattcgccgggcgagacagtaaatgacacgtcgcgaagggcccagtgctcgcggtaaagcttcttgccgccgggcacgagcatctggcgcagccggtcctggggccgggcgtagagctcgtacatcttggagacgtttcgcacgtcgatgaccggggtctcagacgacatcggcaaaaagcctcttcacattggtaaaaaaggagtacccggccagcatgaccacggcgcaaatgacggtggtcagccccagggccggccagtccggcatctgaccataaataatggtccggcgcaggtggtccaccacgggatgcagcggattaagcgccaaaaggtcccggtacggctcgggcacggccgagagcggatagaggatgggggtggcgaaaaacagcagctgcacaaccacgccgatgatgttgcccaggtccttgagaaacacccccaccggggccagcagccaacacagccccaaagtcagcatggccagggggatgtaggccaggggggccaaaagtgcggtcgggtgcaaggctccggtggtgaccagcacccccaggaccaccagggacagggcggccagggattccaggcaggcggccagcaccagccccaccggcaggatctccaggggaaactggacttttttgatgaaattgacgttttccgaaagaagtctcggcgcgcggttcacactgcccgaaaagacctcaaaggccgtcagcccggcgaacaggatcagggcgtaaccggcaacgccgccgtcagccccggcccaggagggcttgaagaccaccgagaacacgaaggtgtagacggccagggtcgccaggggggaaacgaggctccacagcgccccgagctgggccccgtggtagcgcgaggcgaactcgatgcgggtaaaagcggccaaaagctcgcgacgacgccaaaaggcccgggcaaaggccaccggaccgaggttcgcggctaggccggcccacaaggagccggcccggggccgccgcacgaccatgaccttggattgcgtatacatggagccggttgcatattcgatggaattgacgcatgtcaacgcatccgacacgccccgcaacctcccaagccaagcggaccttcatgcgcatcaccattgacgccagttccttgtcctatcccaaacgcaccggcatcggccgttgtctggaatccgtcctgccccatctggcgtccctggcccaggcgcgcggcgacagcctgacccttatctcgggccagcccgtggtcaacgccgccgccctggccctgatcgaggccggagccgtccgcgccgccacggtcaacgtcccctcgctctacgcctggcaacaggccggcatggcctggcagacgaaagaagtcggcagcgacgtgcactacgccccggacggcctgctgcccgtcggctttaccggccgtagcctcggcgtggtcaacgacgtcctgtggaagcgcatccccgagaccctgccgcgccacatccgctgggtgttcgccttgcgccagcgggccagcctggaaaacctcaccataccgctctcgctttcggccttcacccgggccgaggccctggccctgtacggcgaggcggcggctcgcatccgcccgaccagcctttgcgccgtggaccaccaccgtttccgcccggcccagcccgccgatacgggtgatgctggcgatatcgcttccctggccgatttccgcgcccgccacggcctgccggaggcctttttcctgtgcgtgggcaacctcatggcccacaaaaatctcaccgtggccctacgggctatggcccggctgcccgaggatgccgtgttggccgtggtcggccacggcgatcctggcgcactgagcgtagctgccctggcggccagcctgtccccgggccgagtgcgctgcctgggctatctgcccgacgacgatctgcccctggcctaccgggccgccgccgctttcgtctttccctcgcgctacgaaggcttcgggctgccgctgctcgaagccatggccagcggcacgcccgtggcctatgccgaggccgcctccctgcccgaagccgccggcggagccggcctgcccttcgccccggacgacgacgccgccctggcctccatcctgacccggcttatggccgacctcgaccttcgccgagagcagatcgccctgggcctggcccgggccgctgccttctcctggcaggactgcgcccaaaatgtctttgacgccctcatcgaggccgccggggaaagcgacaagcggcccaaggtcaccatcgtcaccccatcgtacaatcaggccgtctatctggagcagacgctgacctccgtggccggccagcaaaacgtggctgtggagcatatcgtcctcgacggcggctccaccgacgccacccccgacatcttgttggcctgggacggccggttggcgttctcgcgctcggccaaggacgacggccagaccgccgccctggccgaaggctttgcccgggccacgggcgaggtgttggggtggctcaattccgacgactggctgtggtccgacgacgcgcttcgcgccgtggccgaggccttcgccaagcaccccgacgcggtcatggtcaccggcgacaccgtgctgaccgacgccgagggcaagcccgtcatgatcgacatggtgctgccctcctcgcgccagatgcgctacaccatggccgtgccccagcaatcgacctttttccgcaaatccgcctacgaggcggccggcggcatggacacgactttttcctactgcatggacttcgacctgttcgagcggataagccgccagggtcgcatcgtgcgcctgcccaaggtgctggccgccttccgcctgcacccctcggccaagaccgccacctggcaggaggtctttcgccgcgacgtggccgcctgccagcaccgccacggctccgggttcctgcatgaactcaaaatcaagctcgtgaccctggaagtgcgtctgggttcggtcctggcccagcttggcgccatcgccaagggccggccgttgcccagccacgtcaattgccgcctggaacccctgcgtgcctatgcccgcaaaaaacacggtctggccggatagcccatgcgcatcgccgtcaacgcccgcaccctggcctatccctccggcggccccaaggaatatctcttaagcctcatgcgggccatgctcgacctggacgccggccacgacttcacacttttttattccgatcccaaggacgtgggcaccttccccgaggccgaggaaatcgtcctgcccacggccaaccggctggccttcgactggctggccctgcccctgaccctgcgccgccgccgcttcgacgccgcctttttcccctcgtccaacatgccccccggcattccctgcccggccgtggtggccatgctcgacctcggctacttccacccgacgctctccatgtaccgggccgccgacacctgctacatgaagttcgccatccgctacagcgccaggcgcgccgagcgtctggtcgccatctccgactacacccggcgcgacgtcctgcgcctgacccgggccaggtccgaacacgtcgccgtcacccacctcgcctgcgaccccatgtacaaggccccggtaactgacgacgccctggcccgcttccgcagcgaccgggacctgccccaggatttcattctctacagcggcaacgtctcgccgcgaaaaaacttgcccgtgctcctggccgcctacgcccgactggctgaccggacctcttgcgatctggtcctcaccggcggcctggcctggaacgaagatttcagctccctgacgcgccaactcggcctgaactcgcgggtgcatcgcctcggccatgtgccgcgcgagcacatgccactgctctaccgctgcgccaaggccctggccttcccttcactcttcgaaggcttcggcctgcccatcctcgaagcccaggcctgcggcacgcccgtggtctgcgccaacgccaccgccctgcccgaagtggccggacgcggcgcgctgctggtcgatcccgcctccatcgacgcctggacccaggccctcgcccaggtccttgccgacgacgccctgcgccgcacgctcatcaccgaaggccacgccaacgaagcccgcttcacctgggagcgcaccgcccgccagaccctcgccagcctcgaagccgctgctgggggagagaagacgtgcctccggcggccgggggcctgaggcccccggaccccccaacgagagaaaaagttaaagggggggcgacggggagtggttctttgtcggctgggaaggcaacaaggctgggtacgatgtttgacggcaactagcctgcccccgccaccctgaatggggagcgacggtcttgcaggcctttttaatttacggtatgaacagtatcgtaattagcgcgcctccggccgcggcagcggccataccatagcgtcaccaaaggagaacgccccatgagcagaaaacgtatcgtcgtcatcggcggcaccgccgccggccccaaggccgccgcccgggccaaacgcttggacgaaaacgccgatgtcaccctgctgcaaaaagcccccaacctctccatggcctcctgcggctacccctactacgtcgccggcagcgtcaaggagcgcgacaaactcctcgccaccccggccggcgtggtgcgcgatccggcctttttcgccggggccaagggcgtggccgccctgaccggcacagaagtcacggccatcgaccgcgccgcccataccatcgcctggaaacgcgccgcttccggcgagaccggccatctcccctacgacaagctcatcatcgccaccggctccagtcccaaaattccgcccatcccgggccgcgaactggccggcgtcacgacgctcgccagcctggaggacgccgacctcctgcgggaaaaggccaaagccatgcccggcggccgggccgtcatcgtcggcggcgggctcatcggcatggaaacctgcgaggccctgaccgacgccggcctggccgtcaccgtagtcgaggccctgccccagatcctcggcttcctcgatcccgaactggcgctgcttgtcgccaaccacgccaaggccaagggcgcggccgtgctgacgggcgtgggcctaagcgaaatcctcggcgcgaacggcgcggtttcgggcgtgcggctggccgacggccgcgaactgccctgctcgctcgtggtgctggccatcggcgtggcccccaacgtcgccctggccaaggccgccggcctggaacttggagccaccggcggcatcaagatcgacgcccacatgcgtacctccgacccggatatctacgccgccggcgactgcgtggaagtgaccaatcgcctgaccggccagcccatgctggcgccctacggcgatctggccaacctcgaaggccgggtggccggcgaaaacgccgccctgggcgatacggcgaccttccccggaaccatcggcagcggcatctgcaaggtgttcgatttcgccgccggctccacgggcctgtccgaacgccgggccagggaagccggcatcgatgtcgtttcggccgtcaacgccggttccgacatcccgggcttcatgggtgccaaactcctcgtctccaagatcgtggccgaagcaaaaaccggtcgtatcctgggcttttcctgcgtcgggccgggcaacgtcaaccggcaggtggccgaaatggccatggccatcctcggaggcctcaccgtggacgatctggccatggccgacctgccctacgcgccgccctactccctggccatcgaccacgccatcgcctcggcccacatcctccaaaacaagatgcgcggacttatgcgcagcgtcggcaacggcgaaatcaaggcccgcctcgacgccggggaccgccccttgctcctcgacgtgcgcggccccaaggaattcgagcgcacccgcctgggcctcggcgagacgctcattcccgtgggccaattgcgcaaacgcctggccgaactgccccaggacaagaccacgcccatcgtggcctactgcggcgtgtccatgcgggcctacgaggcccagcggatgctcctggccgccggctacgacaacgtcacggtcatggaaggcggcctggccgcctggccgttcgcgcgcgagaagtaggtaaaagtaaagagagacaaagaggaagatgcctccggcggccgggggcctgaggcccccggaccccccagttggagaaaagtgttagggggttttcgacgctgattggttgtctgcccggtcggcaagtcaaagagcatgaggtacaatgctgttgcttcggcggccgggaaaggggtttcccctctcccggcccctctttgtgggggcgagggttacgagcgcgacaagcgcggctgtttcggctacaccgggcaaaacgtttcggagccgcgcccatgaaaagctttcgcaaggaactgtggttcaacgtcccagcccgccgtggattcgtcaacatcacccgcgacgtcgaggcctgcctcaaggaatcctgcgtcaccgaaggcctgtgcctggtcaacgccatgcacatcacggcctcggtatttatcaacgacgatgaatccgggctgcaccatgactacgaagtctggttggaaaagctcgccccccatgaacccgtgtctggctaccgccacaacgtcggcgaggacaatgccgacgcccacatgaaacgccagatcatgggccgcgaggtcgtggtggccataacccagggccgcctggatttcggcacctgggaacgcatcttctacggcgagttcgacggccggcgcaaaaaacgcgtgctggtcaagatcatcggggaatagtcccgcccacctgcagcgacattgcccctatgatccttcgcccgcttccgtttgccctatgaatgcccatcatgcctcttcagtacacggccctcggcccaaccccggccgcaagcactggatcgactggctgcgggctatcgccgcctttgccgtggtggtcatccatgtcaccgcgccgctctacgcccaaatcgccgtcctgcatcgcaccgactggtggatcgccaacgtcgtcaactgcgccgtgcgctttgccgtgccgcttttcgtcatgctggccggcgcgctgctgctcggccgtaacgagaacgccgccgccttctacggcaaacgcgccgcccgcctgttgcccgcctttgccttctggagcgtgttttatctgctctttgcctgggccacgggcggcgacggcctggatatgcgggagcgcttcgtcaatgccgtgctggtcaccggcgcgacctattaccacctctggtatctgcccatgtttttcgggctcatgctcgtccatcccttcttaaacgcctggctcatcggccggcggcccgaacgggccgatctggtcgcctttttcgcggtggtcgcttttttcgcggccctgcaccaggcggcggaactcatcgaagccatcaagggcctgcgcctggaatgggccggggcctttgcctggttcgtaggctgctacgcggccggctacgtgctcgaaacgcgcctgaaccggcggttgcccaatgtgctgctggtcagcgtttttgtggccgtcgtggccgtcggggcgctgggcaatttcgccctggtcatggccacgggactagtccagcggcagtatctgctgccggatgccggcgtcgccgtcctggccctgacagcggccttgttctgtcttttccggcaaaacgccgcatcgttgccccaaagccggttcattgccgcggcggccgaagcgagctttggcgtctacctcatccatccggtctttttgtacgtcctcgaccacgccctgcccctgcctcagcgaggggcggcctggtacattccgttggcagcgatgggcgtcttcctcgcctccttcgggaccatcgcggccttgcgccgcatcccgctttttcgctccgtctgctgaggcgcggccgcgccgccgccttaccgcctcgccctcgacgacaaagcccggacaacggcgcgccaacgtcgttgcccgggcctgtaaaaaaacgaaaagtcataccccgttatttggcgctggcgtagagcgtcttgatggactccccgagtttctgggccagaggcgaggcggccatgcggtccatgaccacttcaatgtaggctcccgtgccgcagctctcggccttggccatggccgcttccagctcggcgttggtcgtgaccttggcgcagtaccagtccgatagcccaaacgcggccggcagctcggcatacttccagggagccaagtcgttgtaggaactcatggggttcttgcacagcaggcgctcgatcagatagccgtcgttgttgaggcaaaagacgatgggcttgagcccatgcaggccgaactgcccgagttcctgcacggtcatctggtgcgcgccctcgccggtgaaaagcagcgtgcggcgatccggcgcgccaagggccgcgccaaaggcggccggcgtggcccagccgatggctccccacaaggtctggttgaaaaattccgccccctcgggcatcagcgcaaaccccaggcccatggacaccgtgccggtctcggccatgacgatgtcgccgggacgcaggaatttctcccaacgcggatagaggtagtccggggtgatgggatcacccggcgcgcccttgggctcgcccaggcccttggcccgggggtggctgatggtcttggccggcaaaaggcggtccagcccggccaggacgtcacgcatttcgacgttggggaaggtggcgtaacccacccgcacctcgtgctgcatgacagcgatcatgcggctttggtcgatgtgggcggtaaaagcgccagtgttgaaatcactccagtgcgccccgaggttgagcaccagatcgcagccttcgacgaaatcgcgcacttccgggttcatgatgcgcccgtcgtagagtccgacatagccgggcagcgtctcgtccagggccgttttgtccatgaacatggtggcaaagggcaacccggtccgctccagcaactcccgggcggtctggcgcagcccgagccgggcgatgaggtagccggccaggaccacggccgtgccggccccggcgaatttctcggccatggcctccaggcaggcggccaggacggccgggtcgcttaccggcgcttccggggcgcagacgtactccccgggcagggccttgttggcctggtcctggggcagggccatgtagaccggccgattgcgggtcagccccgcctcgatgcagcgttcgatctggcaggcggcgttttcagccgtcaaaatggcgctggcgcaggccacgggcttggccatggcggcaaaggcgtcgaactggccgtcgcccagggtgtggtggaccacccggcccaggcgctgggtggagatgctgggcatcccgaccagatggaacacgggcagatgttcggtgtaggagccggccacgccgcagatggccgacagctcgcccacgccgtaggtggtgcacagcgcggccttgccgcgcacccgggcatagccgtcggcggcgtaggcggcgttgagttcgttggtgcagccgatccagcgcatgtccggatcgtcgtcaatggcgtcgtttaaggcaaaggagaaatcgccgggtacgccaaagacgtcggtgacgccgatggccttgaggcgcgacatgagcagttcgatgacggtctggggcatggaaatcctccgctggatacggcttaaagtgatcggtgccgggcctcaggctacaccaattcccgtgcggccggccagggcccggcccacggcctcgcgcaacaggcccacgtccacgggcttggacaggtaatcgttcatgccgcaggcgagatagcgctccttgtcgccctccagggcgtgggcggtgacggcgatgatgggcacatgccggtcaacgcccggatgcgcgccttgccggatgcgccgggccgcctcgtcgccgcttaggcgcggcatctggatatccatgagcaccacatcaaaggaatgcgcggccagggcgtccagagccagatcgccgtcttccacggcctcgaccgtatagcccattttgccgagcatgacgaccgtggccagacggttgacggcgtcgtcctcgaccaccagcacccgggccgggccttccggcgttttcgcctgccgcgccttgaccacagcgtcctttggggcttgctccagtttgcatggcagggaaaaatcgatgcgggtgcccacgcccacccggctttccacggcgagaaaaccaccaagcagggtcaacaggcgtttgacgatgccaagccccaggcccgtgccgccaaagcgccgggtcagggagccgtcggcctgggtgaaaggctcgaacacgtcgtcgagcttctcctcgggcatcccgatgccggtgtcggccacggtgaaaaggagcaccgccgcctggccgcgctgcgaagccagggcgatgtccaggcgcaccgaaccggcctgggtgaatttgattgcgttgccgaccagattaaacagtatctggcgcagtcgcgcgccgtccgtcagcactcgggccggcacatccggggccacgaccagcccggcgtcaatccccctggcccgacattcgatggaaagcgccccaagcacatcggccgtcacgtcgcgtacgtccacgggcgtggatttgatgaccatggctccggcttccagcaggctgaaatcgaggatgtcgccgagcaccctggtcagcccccggccgcatttgagggccgtggtcacgtagccggcctcctcgcggccgagaggcgctgtttcaagaagctggagcatcccgagcaccccattgaggggggttcggatctcgtggctgatgttggcgagaaactcgcttttggattggctggccgtctcggccacaaccatggcccggcgcagatcgccctcgatgcgcttaagggcgctgacatcgaagtaaaagccgtcaaagagcaccacccgcccgcttcccgggcgcggcgcggcccggaactggccccaaatcacgccgccgtccggagccaagatacgggcctgaacatcgaacggctcgcccgtggccatgctctggatctcggcctggcgcaggcgctcgcggtcgtcttcaacaatgctggcaaagaccagctcggcgtcggccagggccagggccacgggcagccccaggatgcgttccaggccctgactcacgtagaggaagcggtggttgccggccgagtccacctccagggtgtagatgacgccatcgggaaggttgtcgcccaggctgcgcagcatggcctcgcggccgcgaagcgcctcctcttcgcggcgcagctcggtgatgtcccggcagatgtccaggcgcaccgtggcctcgcccaggcgaaaccgcccggacttgacggaaaccaggcgctcgtcgccggcggccgtacgcatccgggtttcccggatggtggtgaggctgccgttttgaccaagcaccgaggccggggcgtcgtcgtcggccgggtcggtgaggcccacggcctcggtggtgcggccgatgagggtttccggcgggtagccccattcggcggccaaggcccggttgcagtcgaggatgcgtcccgtgtcgtcgtcgacgaccaggatggcgtcgcgggcctgatcgaacaggctgcggtatttgtcttcgctggccagcatggcctgttcggccttgcggcggcgggagccggcgatggccaagctcgcggccagaaaggccaggaaggatatccaggcgaaaaagaggatgttgttgaggcgggtttgccggctggcggcggcgtccatgcacctgcgcacggtttcgctcagggcgtcggcctgtttttccagggcggcgaaggcggcctgacgctcgacgcccagccacgctctgttgtcagacacggccgccatgccctgcatggccagctcccgaaacgcggcaatggaggcggcgtaacgatccaggttttgaataaacggttcacgctcggcctgcccctcccccacagcctcggccttgcccatggcccgagcaatatcgcggcagctctccagggcctgatcgaagaacgcttccacgtccggaacgcgcacatgccgctcgccggccatgtatcgctccacacccaggtaggctttgaccgtatcggcccgcgcgtgctgcaattcttccaataccggcggataggcttcgaagttctcccgccaggaaacattggtccaccacaacagcaggccggtcaacaaggcggccatggccatggcgtagaggtgcaagtcgatccagccgttcgcgccggcccgacggtcgaggggcatgacggcaaggctcatcgcgacaggctccagagcggcaggttttgccgcccaaagcccaggggctcgatgcgggcagccaagccttgagaaccgaccacatcgcgcagggcatcgttgacggcctcggccagccgggcgtcggccttgcgcagggcaaaggcgctctccccggccggcagggccgccggctggacaaagggcttggcctcttcggcctcgccctggctctcgccggccagccagcgcacggtggggccggagagggccaggcagtcggcccgtcccgaacgcacggcggccagtcccgcgccagggtcaggaacgacgaacaggcgttgtctgggcaggcccatggcgagcaaggcggtttcttcaacggagccgtcgagaacggcggcgacggcgtccggggccgccgcgacgtcttcgtaggaggccagtttccggggattgccctgccgcaccaaaaggctctggccgacccgggcgtaaggcaggctgaaaagcacccgcccagcccgttcggaggtgatgaaaaggccgttggcgagcaggtcgatttgtccggcttccagggcggccagggcctggccgaaatccagcagcacccagcggatgcgcggggcgccaagccgggccagcacggccttggcggtctccggcccgacgcccgtgacctcgccggccggcgtacggaaggcgtagggcggctcgctggaataccccacccggatctccccgccggcccagggcggcgacggctggacggaaccggaacggagatagaccagggccaggagcgtgcccgcggcgaaaaacagcgttacggcgatgtagccccagattttgttcatgcgcccgccagggtgacggttgggacatgccgacccgccaacgacaagcgggcctttgctatcctccaccctatacacggcaggcgtatcctaggcaacgcctccctggccaaccagcggcagtggccaaccaacaacgatggacaaccggaccttgcaacgcttaaaagaacataaaaaggccgcgccatcggccccacaaggagacggccatgcccatcgacctgcgctgtttcgccaccctggccccgctcatgccggccaatgccggcgcgtttcccatcgcccccggggagaccgccctggaactggtccgacgtctggacattcccctggaagaaatcaagctcgtgttcgtcaacggcgcggccgcgtccctggacaccgtgctggccgacggcgaccgggtcggcatctttccgcccgtgggcggcggctgagccgcgccgcccttccgggcctcggcgcgctcctctttgacgcattgctcgggctcgacggacgcgccgtctgaagcgctcgccccgtcaggcaagcggccgcgcgttttgaagcggctttgccgcaacggcgctgcgccgctgtggccgccggtcctcgggccttttggtcgttcggccttagtaacgcggccgaccggcctgccaggcggcataagcggccagccccatttcggccatgcgccggttgttgtcgcgccagcgctcggccagacccggcggcagccctggatcgcagccggcgaagtccgggcactggaagcaatagcccacgccccgctcccgggtgcagtccttgacccggcagtcgcccagcagacagttgcccgtgcggcagcccgagcagccgcccttgcccaggcgttcaaggaccccctcgaaagcggcgtaggcgtcaaacaccggatcgagccgggcaaaaaaggccgcccgctggccaaagccgcccagttcccgggccagctcccgggacagccggccgatggggctgtccgggttgtccaggcaacggccgcagtccaggccgcacggggcgatgcgctcttgcaacgcggcttcttcggtcatgtccatactccttcggtcttgattcatcctcacggccacgccggcccgaggcgctttgccccagcgcggtgcgccggcatcccggtccagggtcgccgacgcgcctttatccccaaaacacggcgcagcccacaaacgccagcccgaccagggccggccgggtccaggcccggcggccgcacagcctggttgcccccagacagacgaaaatcggcaggatagcgcacacggcgatcttgaccactaccggcacggccgtgccgcacagccagtactgcagcaccaccaccggcgggaagtggtacaggtacaaatcaaacgacgtccgtgacaagcccggccgccgccagaacgccccggccctggcccggccgacaagcgccacggccagggccgtggcggccagggcgaaagccgtgcgggccagaccatggaccagggccagcgggacagagggcgcgccggacgcccaggcctgcatggcctcgccgccggtcctggccatggccgccagggtgaaaataaacgccagcccccagccccagggccgaccgggcaggccgtgatcgggcgaccagccgcgcttccagacagacgcgccgagcaggaacaatccggcataaagtggcagcctcgtgggctggaacaccagaaacggccccaacctggcccaggctgggtccgggcaggccatctgtccggctccggccgccaggccgacgcccggggccagcaggccaatacggcccaagctccaccccccccaactcccacgcagcgtcagcccgggcccgaccgccagccgcgcaccggccacaaccaggcaaaaaacgaacaacatggccaaaaaccacagatgaaacgaccacagaagcgtctgggacaccttggcggcgtcggcgctggcgaaaagcaggaaacgccaatccagggccgttggcgcaagagccagccagtgggcgaaaaagccatccaggccgcctttgtcgcggtaatcgacataagcgatgatcgggcagaaaaataatgtcagcccgacaagcggcacgacgagccgcctggcccggccggccagaaagccgcccaggccgcgccggccaagggacggcagaacgaaatacccggccacggcgaaaagcagcggcatggtcgcgccgtcgcagatcagcaagatgaggtctgccagggcgctcttggccggatcgcgcacataccaccagggcacataggcgctgtaggccacggcggcgtgctggagcaccacggccaggacgccggtcagccgtagggcgtcaagctgccaaaatctctccgtggcctgcttgtttgagatcacgtcgcgcctccttggcgggcttgcccaacggcccgaagtccggccagggcgtggcggaagcactgctcggcaaacaccggccaatgctcggccatgggcggatgctcgggcacgatgcgctgatggttttgccacagcaaggcctgatacaggcagggtcccaggacgcaggacatcatggccaccagggtcgtgacgggcgcgtccgggccggcgaattcggccatgagccccagcatggccagggtctggggccggctgtggcgctcggccatgtcgccgagaaagggcgtggggttggccagttccatggcccacaggcgcaggaaagcgtcgccgacctcgccgtgggcaaaaagcacctggcaatacacctcaataagcagccgcaaacgctcctcggggccgtccccggccttggcctcgtccagcaggcgctggcggaaccgctggtcggctgcggtaaaaagcacctccagcacggcctgatacagcttgtccttgccgccgtaataatactgcacggcgctgacgttgacaccgccggcctcctggcacacggcccgcacggtggcccctttgtagcccttggcggcaaaggtccgcagggcggcccaaaaaagcttatccttgatcccgacctcgctggcgtccatgacccctccgaaaacatttgtttcaaacaattgtttgcaaccagtgcccaaaagccacgacctcgtcaagggggggaagtcgtcccgcatcgccaaaccccaagcccggggtcgggccgcttttccttgccaagagccgatccgtcacttatttgaaacactagcggcagtgtctggaatgtggcttggcgcgtggcgcgccctggagagtttgtgatcgcggaacgagacttgcataaaaatgggggaagcatggacaaattgacacccccctccagcagcacgacagcgacgcgcggcagcgtcatcgtggccgtcatcggcgcgatcatcgtcctgggtgtgttggcggcggccatccagaagcagttcggcacgtcgtcgagttccgtggtgacggaaaaccgggccgacagcgccacctatgccgcctattccggtctcgctttcgcggcggcgcaaaacgacagcgcccttgcggccatgcacacggccggggccaccaactacaccctggccaccggcctcaccttcaatctgaccgtgggggcgaaaaatactggaactggaaaatatccggtaagcgtcatcggcacggccaaccctggcgcaggctatgaagccaacgcctacatgtcggcttccatcacgccggtctcttcgggcggcggtgaagatgacggaggcgtgtcggattacgtcatgtcatcaggcggcacggccaaagtggccggctatgtggccggcgacgtcctggccaacaccgtcaccctgcaaggcggttccaccgtggccggatccctcaccaccacatcgaccaccacgccgctggtcatcagcggcggcgtcaccgtgggcggcacgggagaggtcatctgttccaattcgagcatcacggtgagcggcggctccgacgtggtcaacgggacgctctattcccagggcgacgtgaccatcgacggcggggccacggtcaacggcgacatctacgccaagggcagcgtgaccgtcagcggcggctccaccgtcaacggcaacatccacagccaagcctcggtcagcctgaccagcgccaagatcggttcttccacggtcaagcgcttcatctacgcggccggcacggtgacggccaccggcggctcgaccatctatgtggacatccacagccagaccaacatcgccctgcaaaacatcaccgtctacggcaacatgtacgccaagaccggcgtcactacccagcaatacctgacccacctctacggcaacatctacacgaacccgaccgcgccgacagcgccggtggcctgcgccagctacaccgcgcccacagcgccgatatttacggcttcaacggcccggaatattaccagccagaccaccataacggcgggaaactactactatacctcgtttagcacaaattggatcgacctctgcctcgacgtttccggcggcgacatcaacatctttgtctcggggaatgcctccagtaacgccactatctacgttaaaacgtcaacatcgggaaactgcttcaccaacagcaacaagatgaacagcattgacgaaacattttccgcctcagccgccaaggtcttcctctacacggggggaaccttcaccctgggcggcggcgtggactggttcggcacggtgctggcaaacggcaacatctatcccggcggcggctcttccatcatcggttcgctgcacagcatcaacggctcggtcaaccccaacagcacctggtacgagatcaagtacgtccagtcgaactacctgagcagccactaaggcttgcctgcggcatccaatgaaaaaggccggaatatcccggcctttttcatgagaagccacttggcgtttacgcttgatgatgggccaaggcgtttgcccctggcgcgcagcgaacaaggctgcgtgcccttttcacggctatccggcttttgagaccttgtggcttcaaggcccgctcaagcgagcactgtgcgccgcacgggcctacacgcccatgatgttatagccggaatcgacgaaaatcacctcgcccgtggtgcccgacgacaggtccgaggccaagtacagggcgcagcggccgatatcctccagggtgatgttgcgccccagcggggaacggttctcaatggtctccaggatggtgcggaaaccatgaatggcagaagcggccatggtcttgaccgggccggcgctgatggcgttgatgcgcacgccgcgcttgccgaggtccacggccagatagcgcacgctggcttccagggccgacttggccacgcccatggcgttgtagttggccacgacccggcccgagccgtagtagctcagcgtcatgaccgaggagccgggggtgaaaagcggctcaaaggcccggcacaaggcgaccagggaaaaggcggaaacgtcaagagccacgcggaagccctcgcggctggtgtcgatgaaccggccggccaggtcctcgcggttggcgtaggcgatggaatggaccaggcagtccacgccgccgagcttttcgccgacgaaccgggtcgcttcggcgatttcctcgtcgctggagacgttgcactggaagatgcactcggccccgagttcggcggcgatgggttcgatgcgcttgcggatgggttcggcggcgtagccaagggccagcctggccccctgctcgcgcaggaccttggcgatgccgtaggcgatgctgcgttcgttgaccacgccgaaaatcacgacttttttatcccgcatcagcatgggtttctccttgccgggacgcccggcgttatgcctctggggcggctgaggccgcccacatgcggcgtgtcatcccaggctccagaactgtatcacactcccgaccgccgccccaccaacgccccccttgacctaggtggggtttccaaaggggctcagcctctttggccgccgggggcattcccccgcttctccccgtcttcgcctactgccgggtctcggcctcacggataagcccggacagcagcagatccagggcacggttcacgcgttcgcggtcggcgtcgtcgtagaggttaagcccgccgaagacgccgctttggcgggagcgcacggtcaagaagatggccgcgccgccgagcacggccacgatggccgtcaggtccaggctttcgggcacgtcgccggtgacagactcgaaaaattccagagccgagcgcacgcgggggtattccaacagccgggtgtagcggttgcgggacatgagttcccaggccaggatgtccagggtgcgcggccgggcgagcaggccccggatggtggccttgaagaaatgggccagctgggcgcgcggcggcatggcggcgaaacgctctgccacgtcctcgcgcagttcgtccacggtgggccaaaaagccgaggactggccaaaggccgtgaccacgtcgtcgaagtcctggaagtggcgcaggatgacgccgcgttccaggccggccgtccgggccaggaggtcgagggagagcccgtcgaagccttgtttggcgagcaggtcgcccagggcttccaggatgcgctggcgcaccgtgcgcggcttgccgatgggaatgatcttgacgccggacatggtccccctagggtcgcgtccttgatatgaacgcatcgcgtttcacaggaaccagcaaaagccctttgtcatggggcgcgcctggcccggagaaagacgtccagggtcacgagcaagcacacggccatgatggagccgtcgcggatgaaggtggcctgggagatggcgtcgtcggccttggtggtgaagcagccgcactgggtggcgatgcccttgtgccaggcccaggccatggccgcgagaaaaacggccatcatgaggctggccgaaagggacgcgccccgggccacgaagccggtgagaagacacatgcccaccacgacctcgatccagggcagggtaagcgccacggcggatacggccatgtcgggcaatatttggtaattgcggatgatcttggcaaaggccatgggatcgacgatcttgtcccaggccgcgaaaagaaacaccagaccaagggccatgcgcagcagtacgaagaacaccctcatgccccgccctccgtgggtccgccgacggccagccagccgtcgaagccttccggcatcaccgtgacgaacgtgaaaccagccgtgcgcaatgcttcgccgagttccttgctcttgtcgcacagcagattgccgcagtagacgacgatgcggtcctcggcccgcaggccgaggttgccggcggcggcgtcgagatcgccgtacatggcctcctggggcaggttcttggccccggccacacggtgcatggaaaattcctcggccgtgcgggcatcgacgaaaaccaccccgggcttgccgagcatggtcacggcggcatggggatcgatggtctccaggccgcgccgcaaggcgtcacgtttatccagggcggcaaaatccacaatccagggcacgggctcctgccgggccatgttcatggccacggacaggccgacgcccaggatcacgatgaccgccaactccaaccaaagcggcgcaagccgccgcgtcacaacccccgccataccatcccgccttgacaaggtttcccgcccacgagcatatattccgtcgtaagggcttgctatcctacacgcagccccaagcgcaacccgcaacacggagccagccatgtcaaccgacgccgtcccggccatccaaaacgtctcggccgacgaggcgcgccgcctgctcgacgccgcccggccgggcgagatcacccttctcgacgtgcgcatggagccggaatacgaagaattccacctgcctggcgcgaagctcgtgcccctgcccgagctgcccgaccgcctcggggaaatcgaccaggcaaagcccgttgccgtgtattgccgctcggggatgcgcagcgccgccgccgcgaaactcttggccggagcgggatttccccgcgtggtcaatctgctcggcggggccatggcctggcagggcgcggcggcggttggcgcgccggacgccggcatgacgctgctctccggagcagaaaccccgcgccagatcctcctggccgccctgggcatggaagcggcgctgggcggcttttaccagaagttggccgacgcggccggggacgccgaaaccgccgccacgttttcccggctggccggcttcgaggaacgccacttgcgccatgtccatagcctgtatgcaaaggagaccggtgagacagccgacctggaggcgcttgtggccgggaccggaccggaactggaaggcggactgccggcgacggctttcctggaaatgctcggcggcgaaccggcctcggcccgggaggccctggagctggccgcctcggtggaagcccaggccctggacctgtatacccggctggcccggcaaaccggcgacaaagcagccaaaaccctgtatgaaaccctgtccctggaagaaaaagcccacctgcgggccgtggccaacctgctggcccggctgcccgaggcttaagccggcgcgcccggctcgattcacgatcaaccgctcaaggagcacctcatggccccggtcaattttctcatgaacatcctgtggctcgttctcggcggcttgtggctgggcatcggctggtacctggccggcgtggtcatggccatcaccatcatcggcatcccctgggcccgggcctgctttgtcatgggcaacctgtcgttttggccctttggcaaggaagtggtggaccgccgcgacgtgtccggcccggacctcggcaccggaaccttcggctttatcggcaacgtcatctggttcgtgctggccggggtgtggttggccatcggccacctgctggcggccgtggccaacttcgtgaccatcatcggcatcccgttcgcgttgcagcacctcaagctggccggcctggccctggcccccatcggcaagacggtcatcgacaagcgctactagattcgccttatcaaccgggcgcggcgagcgcagcagccgacccggcggccgcgcccaccaacgccggccagctttctacaagaaccggcccttcgccatcggagccgtcatgcagtacattctcttggccctggccttggcggccggaacattcatgcccatccaggccggaatcaacagcaagctggccggggcggtcggcggggccatcccctcggctttcgtctcgtttctggtcggcaccctggccctgggcgtcgttttgggcgtcacaggccagggcgtgccctttacggcggcctacaaggcctcgccgtggtggtactggatcggcgggaccatgggggcgtttttcgtcacggccacggtgatcctggctccgcgcatcggcggcggggccatgatcgccctgaccctggccggccaggtggcggcctccatggcgctggatcatttcgggctgctcggctttccgcacatccccttcgacctcaagcgcctgatcgggtccgtcctgctcctggccggcgtctatctcatccgattctaaacgcttgtcatccccagtttgggggtctgggggcctaaggcccccagcggggcgtggggcagcgccccactcttctcttttcccttattccaattccatttctcaagcgaaagcacattgcaaacaatatattgatttaattttatacttataaaacataactgtcgttatgttttataatgggcattagccccgcgcccggcgcacggccacggtctcgccgccgatgccccagctgtcgcagtcgacttcctcgatgatgacaaaggtggtttgcgggttcttgcccatgacgtcgcgcaggacgttggtgacgccttcgatgaccttggctttctgctcagcggtggcgccgtcgcgggtgatcttgatgttgaccaggggcatggggttctcctttggaatcacgccgggccgaacgcggcggccgtcaaggccgaggcctcctccagccagccacgacgctgtcccgaactgctcgtgacaagggtttcgaacatgcggcggcgtacgtcggccacgccgcacaggccaaagacgcagtccttccagatgcgttccaggggatcgccaaagacctcgcgttccctctgggccgccgtgttggacgtgttgaggaccacggccgcgcgggcggcaagcaagccgcgcggcacaccctcgccgccgtcgccctccaggaactcgtaggccaggccgggccgcatgacccggtccacccagccgaccagcacggccgggggcatgccccaccagttgggatggacgatgacgaagccctcggccgccgccgcctcccgacagtggctggcgataagcggcggcaggggcgcgtcgcggggaatctcggcagccggtaaaagcgcctcaaagccctcggcgcagaggtcgtggaaccagacctcgacgccaaggtcggccagcgtttcgcagacgaccccagccagggcgtggttgaagctgccgggacggggatgggccaggataacgctgaccgccatgggttacgctccttcgccggactggccggcggtgtccgggcgatattccaggatgtcgcccggctggcagccaagaaaggcgcagatggcctccagggtggagaaacgcacggccttggccttgccggttttgaggatggacaggttctgggcagtgatgcccacggcttcggccagctccttggagctgaccttgcgccgggccaacatgacgtcgaggttgacgatgatcgccatatggccagcctataccgtcagggccgcttcctcgtccagccgccgcgcctcgtccatgacccgggccatgaccagggcgaggctggccaaaaagacgagggccagttccgtgccgccaacgcccaggctcaccatgtgccggccgggcgggttagcggcggtgacggccagggaatgcagcggcgtggccagtacggaacacacggcccaggccagaagcgagcgagccacgccgcgaaaggccagcacgttggccagggaaaagaggctgccttcccggtagagaccaaacagccgacgcaaccgcaacagcgccaccatgagcgccgcgcccggaaccatggcggccacaaaacataaaagccgcacccagcccggcaactccgggccggcggccagggacgccgcctgccgggtcatgtcggcgggcaggaagttgaacgcggcccagtacagggcggtcagcggcaaaaccgccacggcggcggccagacaaacggtttcgagccgcccggcctgtcggcggatgctgtcccgattggttttgatatacatggcggactccgttacttgtcggtcggctgcgccagagattgggtcagttcggccagatcggcggtgaaatcgcggtacagcgcctcgcggccccgcaccccgaaggccacggcgacatcccgcccgcgcagggccgacaggaccagggaaccggacctcgcgtcaagcagtctcgcctgataggcaaacgacgtttccacgctccaggccggcgtcagggagatatgcagccggccgaccagggtggccacttccaccagggccacgctgtggaccccgaccgtgcgggcggcggcgaccagttccgtgtccgaggccgcgcgccagtcgcgactgcccagggccgccacgagcggcccggcatccacgacttcggtcccgggcagaccggcaaaacgcgcttctataagaccgcgcagccgggccgccttttccgggccggccttgtcggtcgtctcgaactcaaaccaggtcaacacgacggtcttgcccaggcccagatcgcggccggccggattcccggccacaaggctcgtggttgtggtcctggcgcagcccccggcaaaggccacaagcaacaacagcaaacacatctttttcatggcgtctctccaagaagatagcggttggcttcgaggcgagcgccggccgacgccgccccgggcttccatgcgtccggacagggcatcgataaacaagcttgattcattgttcaacgataaattttgactgtttttcacagacaaacagacaaaagccgccgcccatgaaaaaaagcaaaaaatatcaggcgaacagggaaaggatcgactagttccctgggcaggaaacggacatgagcgaagtaacgcgaaaggactggcaaaggcgtgtgctggccgccatgcggctgatggaagcccggctcgacgaagaattggcgctctccgacatcgccggggcggctcatttctcgccctatcacttccaccgcatctttgtcggcatgaccggcgagacggtgggggcctatctgcgccggctgcgcctggagcgggccgcccagcgcctgtgctacggcgaccagccggtcaccaccgtggccctggaagccggcttcgagtcgcccgaagcctttgcccgggcctttcgcgccgtctacggcgtatcgccctcggcctggcgtcaggccagccgggagcgcaaagggccgcccgaaacccccaaacacctgccccccgcaaaggagttcgtcatcatggaattggatgtcgtcatcaaaaccctgccgctcatgaaagtggcctgcgtgcgccatgtcggcccttacgaccagtgcgagccggcctgggcaagcctttgcgccaaggccgggccgctgggactttttggcccggacacgaagttcatcggcatcggccacgacgatccgcagatcacgccgccggagaaaatccgctacgacgcctgcatgaccgtgcccgacagtttcgccggcacgcccgacctgcccgtggcctccatcggcggccgggactacgccagcgccgtggtcaaaggaccgtacacgaacctggccccggcctacgcctggctgtgcggcgtctggggaccggactgcggccgggaattcgccatggagccgagcatggaaatctacctcaatgatcccaaaaccacccctcccgaccaactgctcaccgaaatcctcgtcccagtcggcccggcgcggtagcgcgcggggagtgcctccggcggccaggagaggctctgcctctcctggacctctccgccgggtgcctgaggcccccggcccccccatccaaagaaacggcccggaacgctttcgcgttccgggccgtttctttgggggcaaaaaaagatcagccgccgccgaagccggccagccccacgcccgtgcgcggcaggatcagctcgcccttgcccatctgggaaaacatggcccgggtgagcttgccggccggatcaagataggccgtcagcgtaaacggcaccatggggccgcgcaccttctccaccagcggattgacggcgataaaccgcagatcctggaaggccagggccgtgccgtcgggcgtggcggcggcggatttgaccggaaaatccgtgaaccagacatagtaggaaaaaaccggagcctgcttgcccaaccgctccagttcgtcgcgcccggcccgctcgaaacgccgctcgggaagcagggtatcgggatcggcaagggtcagacccgtcagcacatagtcgttgccttcctcggcgatgatcttccaccacaagggcgcaaaagcatcgggctgggccgtcacgcgcgtgggcttttcgccccgggcgacaagcagatcgcgggcatgggcggacacggcctgacccacgccaaagccgatggccggccaagccagcatgacggccagtccggccacggccagcttcttgcccgccgccgggcgtagggcggcggccacggccaggccgatcagggccaggctgtagattggatcaatgatgaagaccgagggcacggacacccggacatcggaaaaaggcaggaaaacgcctgttccgtaggaagtgatgcagtcgagaaagaggtgggagagtacgcctaaataaaaaagcacaaagagccgcgaggccttcgcacccccggcgaatcgggaaacgacaagggccaaaagccaggccataagcgccccgccaagcagcgaatgggtgtagccccggtggtggcgcatgtaggcctcagcgccaaaaaacgtaacgatattatcaacatccggcatccagacggccaaggccgagaggggcacaaggggcctgacgcccgggaaacgatccttggccgcctggcctaaaagcacgcccgccgtgatgtgggtaactggatccatgcgacaacttcctcacgtttcaaagacggatttggggaggatagggcttttttcgcatttgacaaggatagccgctgcgctacagtgcgccccggcgcattcgcgcccaaatcacccttttttttcggagcgatcatggcagacaagtcgccggacaccaaggaaatgccggccgagggcgaattcgccgcgctcatggaggcctctttggccgagcgcggcggtgagatccatgttggagaccgcatcaccggacccgttatcgccgtcaccgagaccacgcttgtggtcgacaccggcaccaaactcgacggcgtggccgacaagtcggaatttctcgacgacaacggccagctcacggtgggcgaaggcgacgaggtcaccctctacgtcgtctcggtgcggggcgacgaagtggccctgtccaaggccctgaccggccagggcggcgccgaggcgttgcgtgaggcctacgagaacaatattccggtcgagggcaaggtgacggcggcccgcaaaggcggtttcgacatcgagatcgtccaccgccgggccttctgtccggtcagccagattgatctggcctttaccgacaatcccgaagcccacgtgggccagacctaccagttcgccatcatcaccttcgagcgtgacggcaagaacatcgtggtgtcgcgccgcaaactcctggagcaggcccgggtcgaatccgagctgcgcttcatggagacggtccagcccggcgatgttgtgccggccgtcatcagccgtctggtggcctttggcgcgtttgccgaggtggctccggggctggaaggcctcatccacctgtccgagctgtcctggtcccgggccgagaaggccgaggacgccgtgacgccgggcgaagccgtcaccgtcaaggtgctggcctttgaccgcgacaagaagggccgcccgcgcatttcgctgtccatcaagcaggccggggccgatccctgggacagcgtaggcgaccagttcaatgtcggcgacaaggtcgagggtaaggtagtgcggctggccgactttggcgcgttcgtggaaatcgccccgggcatcgagggccttatccacgtcagcgagatgagccatgtccgccgcgtggccaagccgggcgacgtagttgccgccggcgacgccgtcaccgtgtcgatcaaggacatcgacctgtccaagcgccgcatcggccttagcctcaaggaagccgccggcgacccctggcagggcgtggccgagaccttccccatcggggccaccgtcaccggcacggtggaaaaccgccagcagttcggcatcttcgtcaatctggcccccggcgtcaccggacttctgccggcttccaagctgcgcgacgccctggaaccccagacttatgaacgcctgaaaatcggcgacgagaccacggtcatcgtctccgagatcgataccgacaagcgcaagatgaccctgtctccggtcggcggccagaaggaacgggagaatcccgacgaatggaagcgcttcgtcaagaaggaaaaggcggcggcccccagcggcggccttgggcttctgggcgaaaagctccaagaggccatgtcccgcaagaagaagtaaggccatccccgcgccggcaaaacgtcggcgtggggatgctgttccgtaacgtccagaccgcaagtctaggacgttgcgggaagccacgaaacgaggccaagccgaggcccggccctgccgggtccatgttcaggcggccctcactccgttcttcgggcggagcgcagggccgcttgcattgtcgccccttgtcctgcatgtaagcgccaattgacgcgcgcgcccgatttgggcggcgcttgtggaggaaggatatggccgtagagcccaataagatcatttattcaatgatccgcgtcagcaagtttcacgataaaaaacccatcatcaaggacatctcgctgtcctatttctacggcgccaagatcggcgtgctgggcctgaacggctcgggcaaatccaccctgctcaagatcctggccggcgtggacaaggatttccagggcgagaccgtgctcaccccgggccataccatcggctacctggaacaggacccgctggtggacgtcaccaagaccgtgcgcgaggtggtcgaggaaggcgtggccgagaccgtggctttgctcaaggaattcgaggacatcaacgccgcctttgccgagcccatggacgacgacgccatgaataagctcatcgagcgccagggcgaggtgcaggaaaagctcgacgcctgcgacgcctgggatctcgacagccgcctggacatggccatggacgccctgcgctgcccgccggccgacacgccttgcaacgtgctctccggcggcgaacgccgccgcgtggccctgtgccggctgttcctgcaaaagcccgacatcatgctcctcgacgaacccaccaaccacctggacgccgagtccgtggcctggatggagcatttcctgcacggctaccccggcacggtcattgccgtcactcacgaccgctacttcctggacaacgtggccggctggattctggaactcgaccggggccggggcatcccctggaagggcaactacacctcgtggctggagcagaagcaggagcgtctgcgccaagaggaaaaaagcgagagcgaacggtccaagaccctggcccgggaactggaatgggtgcgcatgtcgccgcgcggccgccacgccaaatccaaggcccgtatcgccgcttacgaatccctggcctcccaggaatccgaccgtctggccaaggaactggaaatcttcatcccgcccggaccgcgcctgggcaagaacgtcatcgaggccgagggcgtgtccaagggcttcgacgaccgcctgctctttgagaatctgaccttcaccgtgccgcgcggcgccatcgtcggcatcatcggccccaacggcgcgggcaagaccaccatgttccgcctcatcaccggccaggaaaccgtggacagcggagccttcaagctcggcgacaccgtgcagctggcccacgtggaccagagccgcgaggcgctcgatcccgagaagtcggtcttcgaggtggtgggcgaaggctatgacaccatccggttgggcaacaaggacgtcaacgcccgggcctacatcgcccgcttcaacttcaccggcggcgaccagcaaaaaaaggtcaaggtgctctccggcggcgagaaaaaccgcctgcacctggcccttatgctcaaaagcggcgccaacgtcctgctgttggacgaaccgaccaacgatcttgacgtcaacaccctgcgcgccctggaagaggccctgctctcctttgccggctcggccctggtgatcagccacgaccgctggttcctggaccgcgtggccacccacatcctggccttcgagggcgagagccaagctgtcttctttgacggcaacttcaccgagtacgaggccgaccgcaaggcgcgcctgggagccgacgccgatatcccccaccgcatcaaataccgccatttcagccgcgcctagttcgcgccgcggataaagaccttcagccgcccgccctgcaacaggggcgggcggcttttttgttgccagatcacggccaagtcttgtgacagacagcacaatcttccgacattgtttcctcgttggagacaagagctcccaccacaagcgcttttgcgcgactgtataaaactgtctcttgtgcttcatgaaagtgacaaaaagaacaaatacaacaatattgacacaaaacaatcatttacctatcgaatctgctagtagagaagaaagaagaacaattgcgattccttcaaccgcgccagaggcttactgtatgcactcttgaaagtcgcaaaactgatttcggtgttattgtcgtcgttgtgctgtcttcgccacacttcaaggagttgtcgatgtctcacccgacccgcgacgttatcgggccgatcccatccgccgccctggccgccctggctgccgccaacctgagccttgccctagccctgtccctgtcccccgattggctccaatccacgcccgccctgctcccgctgtccgccgtgggctggagcgtgctggccgtctggggcgcgacggtttacgcgcgcctgtccagactggcccgaaccgccgttgccgccacgggcacgctggacgccctggccgccggcaatctggccgccacgccgccgcccgtgggcctggccgcccgcaaccgcttccgcgacttttgcgtgagtgacaaaaacgccgtcaccaccatcgccgcctattcccgggagttcgagtccagctccagcgcggccagcgccatggccgccgcctccaagggcgacgccgccgccatcgacgccagggcccgccaactcgcccaggacatggaaaccatggacgccgccgccgacgacaccgccgcccacatcgcctcggtggccgcctcggtggaacagacgcgccaagccagcgacgagatcgccgccagcgtggaccgggccagggaggccgtggaacgcgccgccgaggcggcccgacgaaacgccgtggagatcgccggccttggggaacgcgccgcgacgggcgccaccggcctgaggcaagtggccgactccatagtcggcgtgcgcgaccaggcagccaatctccagcgcgacatggccgcgctggggcgcgacagccaatccatcggcgaagtgctcggggtcatcgccgacatcgccgaccagaccaacctgctcgcgcttaatgccgccatcgaggcggcccgggccggtgaatccggccgggggttcgccgtagtggccgacgaagtccgcaagctggccgaaaagaccatgaccgcgaccagagacgtgggcgcggccatcgcctccatccaagccatggccaagggcaacgtggcggccaccgagcaggccgtggcggctgtcgaagccagcgcccggctggccgaggagcagatcgccggggccgagggcctcatgcgggccatgggcgacgtgggcggcgaggtgggggccatcgccgagaccgtggacagcctgcgagacatgatcttcaccagctccagcgccacggaagagcattcccaggccacggccgccattgccgaaagcctgtccggcgcggcccgcatcgccgaggacatgcgcggacaggctcgccatggcctggacgcggcccgggacatctccggccgggcggccgacgtggcccagtccgtggccggcatggccgccgcctcccagcaggtcaattcctcgtcccgggagctgacgcgcctcaccggcctgctggccgaccagatcggccaattcgagcttggcaggccgccctttgacatcgccgccgtcaaaacggctcacctggcctggcgggccaggctcgaatccatcctactcggccacatccaccttgatccctcggaagtggccgaccatcaccagtgccagttcggcaagtggtacgatgccgacggccgccgttccttcgccggccacccgattttcgacgagatcggccgccatcacgagcaggtccatgccctggcccgccgcattgccgctcttgtcaaccagggccaaagcggcgaggcctcggcgctcatggagcaattcgaggccgtgcgggtttccctgtttcacgccctcaaccaactctacctggaaaaaacggcctgacaagctgccccggcgatgacgtccggctgagcggcacgcgcacacaggacaggcgcatggaccggtcagtgaacgggccatgacgcctcctcgaaaggataacggccgccccgtggttggggcggccgtttgttccgagctcccgtggccagaagccgtaacgatctcctcctaaacgagcctcgctgttcggttgccgacgccacgaaaaaaggccacccaacggacggcctttatgacggtcaaaacaacgcgccaggaacagcccggcaggcgttcagcggttcttcacccgctgcacggccaccatggactccagattgaatttcttcacgcggtagcccatctggcggggcgtgatgccaagctccctggccgctttgtgctggatgccgccatggcggcgcagggcgtcgatgataacggacttttccaggcttttgagcgacggcgcgccctcgccttcgccgccgtactcggcctcgtagctgtcgtcgcggctggggatggtgagatagggccggatgaggtcggcgtcgatacgctcgttttccgccaggataaccagccgctccaccaggttttccatctcgcgcacgttgccaggccagtcgtactccttgagcacggccagggcctctgtggaaaaggtcaggttgcgggcgtattccttggaaaccttgttgaggaaatggatgatgaggctttggatgtcctccttgcgctcccgaagcggcggggtctgcaagggaaagacgttgaggcggtaataaaggtccggcctaaacgagccgacctcggccagggcggccagatccttgttggtggcggccaggatccgcacgtccacctgccgggttttgttgctgccaagccgctcgaattccttgtcctggagcacgcgcaggagcttggcctgaaggcccaggggcagctcgccgatctcgtcgaggaagatcgtgcccttgttggcttcctcgaaacggccgggcttggtctggtccgcaccggtgaacgcgcccttttcgtagccaaaaagttccgattccagcaggttttccgggatcgaggcgcagttgaccttgatgaagggatagtccttgcgctcggacaggtcatggatgatgcggccaataagcgtcttgccggtgccggattcgccaagcagcagcaccgtggcccgggtcggggcgaccttttcgatctggcgctggacatcctgcatggccaggctgcgcccgacgatgtacagcccccgggattcctgggaaagcttgaacttcagcgaaacgttctcgcgcttgagcacctcgaccttggcctcgtatttctcgttgaggctcatgaactggccaatgagcgtggccaccaccgtcagaaaggccacgtcctcattgtagtccacctcgtcgccgaaaagccggtccacattgagcacgccaataggctggccgtggaggatgatgggcacgccgacaaaggagatgcggtcacgctcgatcttgcgcgactgtgtcttgttgagaaacagcggctcatggcggatgtccggcaccacgtacggctcggcggtctggaaaatgagcccggtgacgccttcgcttaagccgtagaccccgcgccgcttctcctcgggggacaacccctgggagacgctgatgaccagcttgcccgtggagcggtccaccagggtgatggtggcccgcttcatggaaagcgtctcggccaggatgcgcaggatgtcctggagcgactgctccaggtccagggcctggtcgatgatgccgcttattgcctgaaggcaatgcagctggagattcagggtctttgaagccatcgggagagttccgccatctggttggtcacggattgaggaccggtgccgccgggtccattacgccgggccacggcggtttcataccgcagcgcctcgaaaacatcctggtcaatcgccgtggaaaatacacgcaattgctccaaggtcaattgctccaggccgatgcccagggcctcggcctgggccacggcccggccggtgatgtggtgggcctcacggaagggcacgcccttggcggccaggtagtcggccagctcggtggcgttgagaaacccctgccccagcgcctcgcgcatccgctcgggccggaagcgcagctcggcgagcatcccggccatgacccgaagcgaggcccgcaccgtgtcgtcggcgtcgaaaaagggttccttgtcttcctggagatcccggttgtaggtcagcggcaggcccttgagcacggtgagcaagcccatgagcgaaccgtacacccgccccacccggccgcgcatgagttcggccgcgtcggggtttttcttttgcggcatgatgctcgacccggtggcgtaggcgtcgggcagggcgacgtagccgaaacgcgggttggcccagaggatgatctcctcgcaaaagcggctcaggtgcgccatgatgaccgaggcgcaaaaaagcgactccagggcgaaatcccggtcggacacggcgtccatgctgttgccgaaggcatgggaaaaacccaccgtgcgcgccaccatggccgggtccagcggataggtggtgccggccagggccgccgcgcccagaggcgaaacccgaacgcgcttcagcgcgtcctcggcccgctcgcagtcgcgcctaagcatccaggcgtaggccagcagatgctgggccagactcaccggctgggccggctggagatgggtgcagccgggcaaaagcgtctcttgatgctcggcggcgcggtcgacaaacaccccggccagctcgcgcaaaagcttggtccagacctccaggctctcggccacataaaggcgaaaatccaggcagacctgatcgttgcggctgcgcccggtgtggagcttgccgcccaaggggccaatcagttcggtcaggcgctgctcgatgttcatgtgaacgtcttccaactcctgccgccagggaaagaccccggactcaatctcctccagcaccagatccaggccggccacgatgcgctcggcctcttcgccggccagcacgccgcgcttggccaacatgcgcgcatgggccttggagccggcaatgtcctgacggtacatgcgccggtcataggaaacggattcgctgtaggcctccatcaaggccccggtgccctcgccaaaccgcccgccccacattttcgtggacatgaatcatccctccgggatgtgccgggggagggaacccctccctcccccaaaaactccaacgggggtttacttcttcaccgtatgtgcggcgctttgccgttaatgcggcgcttcgccgctggcgcaccttgggggcgcaatttcgggcaacgtgtcggccggctttgcggccggcgcgttgcccgaaattgcgcccccaaacgtttagcgtcccgccgtccgacgcacccgaccgagccgccgcacgccctgtcggggagggtccgggagggggtgcccccctcccggccgccggaggcatcttccttttctctttttctctagctactgccccagtccacgcaaccgcagccccaccagccgaatgaagccggtggcgtcggcctggttgtagacttcgtctttttcgaaggtggcgagcttggggttgtagaggctgttgggcgacttgcgtcccagggggtaggcctggcccttgtagagcttaacccgcaccgtgccggtgacgcgctcctgggcctgatcgatcatggcctgcagggctttgcgttccggggcgtaccagaaaccgttgtagaccatttcggcgtagcgcggaatgaggctgtcgcgcaggtgcatgacttcgcgatccaggcaaatgccttcgaggtcgcgccgggcgatgtgcaggatggtgcagcccggggtctcgtagacgccgcgcgacttcatgccgacaaagcggttttccaccatgtcgatgcggccaacgccgtgtttgccgcccagcgtgttaagctttttgatgagcgcggccggggacagcttttcgccgtcaatagccaccgggtcgccgtgctcgaagtcgatggtgacgacgtcagccacgtcaggagctttttccacgggcacggtgagcagataggtgtcggcgctgggttcgttccaggggtcttccagctcgccgccctcgaagcttaggtgcatgaggttgcggtccatactatggtccgagcctttcttgtcggaaggcacggggatgccgttgtccttggcgaaattgagcagatccgtgcgcgaggcgaaatcccattcgcgccagggggcgatggtgcgcaggtccggggccaggacgccggtggtcagttcgaagcgcacctggtcgttgcccttgccggtggcgccgtgggccacggcctgggcgccctcggcccgggccacgtccaccagccgcttggcgataagcggccgggcaatggaggtgccgagcaggtagcggccttcgtagatggctccggcccgcaacatggggaagatgaagtccttggcgaactcttcgcgcaggtcgtcgatgtaggctttggtcgcgccggttgtgagggccttttcttccaggccgtcgagttcttcttcctggccgaggtcgcaggtgacggtgatgacttcgcagttgtaggtctttttgatccatttgaggatgaccgaggtgtccaggcccccggagtaggccaggacgactttcttgatggtgctcatggcgctttccttggatcggcgggccggcgcgcctcctggcgatcaggcggcggcgacgggcgggccggaatattgctgaatacggggaaaccttcgcgtgaggcggctagtcggccgccgtgaaaacccattcgagaatggctttttggacgtggagccggttttcggcttcgtcccagacgatggaggacgggccttccatgacggcgtcggtgatctcctcgccccggtgggcgggcaggcagtggagcaccttggccccgggcgcggccttggccagcagggcgtcgtttatctggtagccggcgaaaatcttcacgcgcgcggcgtgttcggcttcctggcccatggaggcccagacgtcggtataaaggtaatcggctccggcggcggcctcggccggatcggtggtaatggtgacgtcggctccctgctcccgggctttggccaccacggccggatcgggcttgtagccgtcgggcgaggcgatggccacgcggatggggaagcgggcggcggcgttgatgatggaatgggcgatgttgttgccgtcgccgacgtaggcgagcttcaggccgtcgaggcggccggaatgctcgcgcatggtgagcagatcggccatgatctggcaggggtggtaggcgtcggacagggcgttgaccacggggatggagccgtagccggccaggtcgaccagcttgtcgtggccgaaggtgcgcacgatcaggcaatcggcgtagcgcgacagcacgcgggccgtgtcgcggatgggctcatcgcggccgagctgggaatcgttttgggtcatgaaaatgggccaaccgccgaggtggcgcacggcgacctcgaaggacacccgggtgcgggtggaggctttttcgaaaatgagaatgcaggtcttgccggccagcagatcgctgcggtggtcggcggccttcatggcggcggcccggtcgaggatgcgggcggcctcgtcgcggctgaaatcgaggatggtcagaaaatgtcggggcattgcgatatccttccggagcgacttcccagaattggtaaaaaagaagtcgttacccttcaaccgcgacgtttgtaaagcgctgtcatggccgccgtggcctgccgccgccttgtcgccgcgttgaccagggccagggccggtgctagaagcggcagatgggaaaacctccccgtctgccggcctggttgcggcaggcctggaggcgacaagccggcatctgttcccggcccaggaggcttgcatgaagacgatctggaatctcttggcattgttgggattggtcgcggcgctttcgggctgcacggtcacggccgcgcccatggtctacgtgccgccgccggcctgccccgaaggctactactacgcctcgggctacggctgcctgcccctgccggccggcgtggtcgtaccgcctgacgcggtctacgccgtggtcaacacccaggggttgagccttcgcagttgcggttccacgcgctgcgacatcatcaattcccttaatgccggcgaacaggtgcaggtgctcagccaccaaggcgactggacccatgtctgggcctttacccgaggccaggaaggctgggtggccagccgctacctcaactagccggactttgggcggcaagccgtccgagccggtctttttccgaaacaacagtccttgttccccgaggccgccaatcaggcgacctcggggacatgacgacgccccagccaggttggccgccccttcgcttctggacaaagcgccatgccgcgtctatacgccagcggatgcgaaatgttttggaccgcccttgccctgggcgcaccacccctttattgtcccgagttttcacggcggcgctcctggcagcctgcctcggcacgacggttttcgcccccgaggcctgggcaaaaaagcagcccaagaaccagccggcggaaaccgagccggccacggcccaatccctggccgccgcggcccaaccggcctgctcccccaaaaagatccttatcgtcggcgactccttcgccgtgggtctgggcatgaccctggaacaatccctcaagccccggggaccggtggccctggccagcaagggcaaggtttccagcggtctcaacagccccaagttctatgactgggaaaaggccctgggcgagttcctggacgccgagaagcccgacgccctggtggtcatgctcggcggcaacgacgccaaaaacggcaagggaacgccggagtggtcccgggatttccaggccaaggccgagcggtttctgtccatcgccgccggccgtggtgtgcccgtggcctgggtggggctgccgcccatgcgtgaaaagaccttcagccagaaggcctggaccgccaacgaggccatgcgggcggcctgcgccacttccaagggttgccgcttcatcgactcgtgggatctttttgccgataattccggcaatttctcggccaaaaagccggtggccggcaaggccgttccccttcgcggcaaggacggggtccacttcagcccggccggctgcaagctgctgaccgaccgcatcgccaccggcctgcccgtggcaccctgacgccgccaacccgcgcgcctaacgccgatacccccgtaccatccatgagttggaaaaaagcctgcctcgtatactgcatcgccctggtcgtcgccatgttggccaacatcgaaaaggtgtcggtctgggtggacgatcgcctgggcgacggcccggcctcggaagcggcccggcaggtccgccgggtgcgcaatctttggcgcgagacccagctggccgcccattggcggcagcttgactgcgacatggccgcctatttcgacgagacgtataaaaacaacttggcctgccgcgaggaaccgacctccgacgccgccgcccaggccttgcgcgaacgcctggaccccaaccagcccctgctcaagcccgacgagcccatcgacgccgacaacctgctggctgccttgtcgccccccaaaccgggcgcggccgagagcgagaccactgggccggccgtggcccacgcacccccgtccggccagcccggctccggggaacaagccctgacccagggcaagggaccggctccgcgcaagctgctggtggtcggcgattccctggccatcggcctgtccctgtcgctgcggcgcagcgtggccgaaatcgagggcctggaactcatcgaggaaggcaaggtctccagcggcctggccaatcccaaatattacgactggagccgggcgctgcgggtctttctcgacaagtacaagcccgatctggtcgtggttatgatgggggccaacgacgccaagtacatcaacgtcaatgaaaaaccccgctcgcccggcaatcccaacaagacctggccggaagtcttttccatgcgcgtggaggatttccttaccgccatgcaggaaaaaaacatccgcaactactggatcggcctgcctgtcatgggcgacgcaccctacgccaagcaggtcgagatcatgaatgacatcgtgaaaaccgaggcggccaagttccgcaacagcacctacctggacacctggacgctgctggccgacgaccagggcaactactcgacgtttttgcccaacgacaaaggggtcaagatcaaggtgcgggccaacgacaaggtgcacttcaccgtggccggcggcgacatcctggcccaggccttcctggcctccctggccaaggacgtggagatcacggccaagaaaccggccgccgccgcgccccaggccgcccagacggcccccaagtaggcggcgggagaacacgtgcccaatcccaccgccaaggacgccggccccgagccgcgacaccggacgccggcccgtcagccgagggcggccgaccgccgggaacatgccgcccgagccgcccccggcccgacccgccgcttcctggccgccctggcctgcctggcctgtctgctcggcacggcctgcggccaggacgaagcgcccaaatccgctgacgcgcccaaaacggcggcctcgtcccagccgccggccaagaccgcgacactgccccagtcttcccagacgccccagttatcgccgtcgtcccagacacgggccaaacgcctgctcgtggtcggcgactctctgtccatcagccttggcgaacagctcgaacacgccctggccggcgcgcccggcctggatttttcccgcgacggtcagcgctccacgggcttaagccgaccggaactcttggactggccggcccggctgcgggaactggtcgccaagtccccgcccgacatcgtggtcatcatgatcggtgccaacgacgtcatgccgctgaccgccgccgacggcaaccgggtctatttcgaccagccggcctgggccgaaacctacaccgccaaggcccgggaactcctcgccatctgccgccaggccaatcccgacgtggcgataaactgggtcggcgcgccgtccatgggcgacgcggccctggccgtcggggttaaacgtgtcaacgccgtgctggccaagttgtgcgccgaggcgggctgccggttcatcgacgccgaagccgctttttccgacgccgatgggcgttatacccgccacgccagggacgcggccacgggcgaaaccacggccatccgcaccgccgacggcgtacacctgaccgaagccggggctaggctcctggccggcgtgacggccgcttccctgaccggcaaggaacaactgccgcctgcggccggtctcgacgaactgcgcgcccaggctcgggatctgcgccccgtggccgatcccgccccccaggcccaacgcgaggcctccggcaaaaccaaaaccaaggcccggcccagcggcaaggtctacagcgtgcgcgacggcgacaccttccgtttgatcgccaaacgcctgggcgtgtccgaggaagacctcgtcgcgctcaatcccgacgccgatcctagacgtctgtccatcggccaatccttacgcctgcccgtgcgccgccgctaggttcgcgcaacgcggccgcctgggccgcttcgaccagcccggaactccacgacttttcgccgttgacccggccaaccgccatgggtcatactcccgtccggggatattgtcgcgacgattgggccaagcaaaagcgccgcagccacgccgaaccggcaaaaccgggccctctccggttgcggctgcgccgtctggcatcgatgccgtcgcccccattggccggcaagatgagccacgccccgacaacgccgccaaccatgaacagcacacgaggtcgcctgccctcacggagatgcgccatgcgtccgcttgccagactgattgttccactgctcgcagccgtcctggttctgccgggttgcgccaaacgcccgccggctcccgcgccgaccggcgatgaaacgactactccggccgaggccgaggtcaaacccgcgccggtcgataccctgcccacggccgtgccgccggccgtgccgccgttgcccaaggcggacctcgccgtggagccggccgtgcccgaacaggccaccaagcaggccctggaacccaaaccagccgtcaacgccgccatcaagcctccccgttccgaaccggccgcgcccgcctccgagtccggccaagccgccagatcggccgaggcccaagccgccgccccaaaaacgaagaacgtcgacgggccgatggtggccgtggtcggcgattccctggccgtgggcgtgggcatgaccatggaacagcgcctggccaagaccggcgggccgggctgtctggccatgggcaaggtttcgacaggactcatttccaagaaatacgactgggataaggcgttggccgagaccctggcccgccagcccgtctcggccgtggtggtggtccttggcggcaacgacgccaacaacgccatcgccggcaagggcgcgggcacgccggagtggcacgaggcctacacggccaaggtggagcgtttcctggccatcgccgccaaggccggggtgcaagtcctgtgggtggggctgccggccatgaaggacccggcctacggccagcgcgtggcggcggtcaacgccgcggcccgggccggctgcgccaagacggccggctgccgctacctggaacccggcgacgtctttaccgacgcctcaggcaattatgtccaggccaaggacatcggcggcaagaccgtcagcctgcgggccggcgacggcgtccacatgaccatgaccggctacgacctgctctgtcgccgggtccttgatgtcctgggtccggccgccagtccggccaaaccgtaaggaacttgcccatgcgtcgccaactgtcccaggccgaggtgctggccgccgtggccgacgacgtcttcgccctgcccgaccagcccctcgcgtccctgaccatgggcacatgtctggccgccgtggcctcgcgcggcctggggttggcctcgctggtctcccacatcgtcccggggctggccccggcccggcccaagaccgtgccggccacggtccacgaggcgctacggctgcttgccgacccggccgccgccgagactgatctggcctcggtggccctggccgcggccaattccctgctgccgctgcccgaagacgtccgcgacggcgcggggcaggacctgctcatgtccctcggccggggcaaagacgtggccgtggtcgggcactttcccttcacggccagtctgcgcgaagcctgccgttcgctgtgggtcttggaaaaacggccgcgaccgggcgacttgccggccgagatggccggcgagatcctgccccgggccgacatggtggccgtcaccggcaccaccctgctaaacggcagcctggccgggctgctttccgcctgccgggacgacgccgtggtcatcatgctcggccccaccacgccctttgccccgggcctcatgcgctgcggcattgacgtcctggccggctgcgacgtgcccgaccccgaggcggccctggccggcatccgggccggcagctgcttcaaggggctttccggcgtgcgccagtgctcctggctgcggccggggctggccgtttagggcggcttcccagcccacccctccggccgccgtatggcggccaaacgccgcgtcgcgttcccgagacgcttacgccccgaacaaacggcgcgcccttgacggcgattttgcttccggctcccgtcgctcccgtcaggacgccccacaacgaggcgacgcgccctcaatggcgtccgccgctcccgggacagcccggggctgaccctgggcagactgtttcgtcgtcgtcatgttcccgacaggacggatcatccactgcttcgccgcgccgcaacacggcaaaaccgtagacgccggccagggtcgaggccacgaggatggacaccttggcctgctcgccggcggccgcgccgtcgccaaaggccaggccggcgatgaagatcgacatggtaaacccgatgccggccaacaccgaggccccgtaatagtgggaaagccgcatcccctccggcatggccgccagccccaggcggaacagccccaggcaggtcaggaagatgccgagctgcttgccaatgaaaagccccaggaagatgcccagggacaccggctcggccagggactgcccggcctggccaaagagcggcactccggcgttggccagggcgaacagcggcatgatgccgtaggcgacaaaggggtgcagggcgtgctccaggcgcggcaggggcgcgctggcccgcaggcaggcgctttccaggttttcaagggtcccctgcatggtcttgttggccaagagggcctgacccggctccatggacgcggcaaagcagtcgaggagccggcgggccttgtgcaggaacgccccggccgaaatgcgggtgcgcgccgggatggtcatggccgccaacaccccggccacggtggcgtggacgccggatttgagaaaggccagccacaagatcgcgccgcagatgccgtaaacggccggatggcgcgccccagccatgttgagaccgagcatggccaggaacatggctccgccgacggccagggaaatgagcgaaatatcgccggaataaaagatcgcgatgaccagcaccgcgccgatgtcgtcaacgatggccacggccgccaggaagaccttgagcgaaaccggcacgcgattgcccagaagcgacaagatgcccagggcaaaggcaatgtccgtggccatgggcacgccccagccggccatggtcggcaacccttggttgaaaagggcatagaacaaagccggcacgaccatgccgcccacggccgccgccacgggcagaatggcctgggccggcgaattgagttcgccgaccaggatttcgcgcttgatttccaggccgaccatgaaaaaaaacacggccatgagcccgtcgttgatccagtgcagcagggtcttggacaggacgtggtcgccaaagcccacggtcacgggcgtttcccacagggcgaaatagcccggggccaggggcgaattggcccagaccagggcaatcatggtacaggcgataagcacgatgccgcccgaggcctggacatggctgaaacggcgaaacggggccaaggcctgctccagcaggggcaacggccgggaagtggttagaggatgatttgccatgcaactccaatacagttgagtgcagtattttgcacgttgacggtgtgacagccgaggccgcgacatgtcgcctcggacgattcgagattatctagtgtaagacagcttcatgcgctgggcaaggcaattcggaaaagctcattttccgtggggcttaacagccaaaacccctaagactacccgggccggcgtcgtacgcgcggcccattgcgccgtccagcaatcacctgcttggacaatgtcgacagagcgtcagccatggaccgcccgctacaggcgatacgcctgcctggaccaaccgcgagcggccattgcccccgtgccggccttgggctatagaccgccgaggaattgcgtatcccctatgtcccatcctttcggcatatcccatcctcccatcgctcccgacgcgccctggctggcccccctggccggtttttccgatctgccctttcggctgctgagccgggaactcggcgcggcggtggcggtaacggaaatggtcagcgccaagggccttttttacgattcgcgcaacaccaagcgcctgcttgacacctgcccggccgacagccctctggtggtgcagctttttggggccgagccggactacctggaacgcgccgccgtcgccctggccgaggccggttacacgtatttcgacctcaactgcggctgctcggtgcgcaaggtggtcaagaccggcgccggcgcggccctgcttggcgacccggaccggctcgtcgcctgcgccagggccatggtccgggccgtggggcctggccgggtcggggtcaagctgcgcctggggcccaagcctccggcccgggtcgatctggaactggccatacgcctggccgaagccggcgcggcctggctggccctgcacccgcgccacgccagccagggatttgccggcacggccgaccggcaggccctgggggaattcgtcgccgcctcaaccctgcccgtcatcgccagcggcgacctcatgaccgccgcagatggccgcgcggtcctggcccaaaccggcgcgcaaggcgtcatgtacgcccggggagctttggccgatccccgcgttttcgcccgccatgccgccctttttgccaacgaaggccagaccacgccccgagaagtcccgtcggtgtgcgacgtcatccgccgtcatgccgccctgtgccgggaatatgccgacgaccgccaggcgcttttgcgcatgcgcacggccgtgccccgctacctgcgcgacctgcccggctgccgggcgctgcgcgaccgattgtgccgggtgcagtcctggaacgaactgtccgacatcataagcgaggccgaggccctagccgccgcctcgccccaagccgccggagaagccgcatgaaactccttcgcgcccagaccgccggattctgcatgggcgtcgatctggccctgaaaaaactcgccgccctcatcgacgccccggccaaggacgccccggccaaagccatcgtcaccttcggccccatcatccacaatccgcaggtgctcgaagactacgccgccaagggcgtaggcgtggtcaacgacccggccgccatcgcccccgggaccaccgtggtcattcgcgcccacggcatccccgaccccgtgcgccgggccatcgccgaccggggagccgagatcgtggacgccacctgtcccaaggtcaaaaaggcccagaccctcatccaggcccaggccaaacaggggcggaccttgctccttttcggcgaagaggaccatcccgaggtcaaggggcttttaagctacgccacggccggcgcccacgttttcggcgacatggaagaactcgaaaagctcgacctgccccacggccccacctatttcctggccgcccagaccacccaggacgagcaggaattcctgcgcatccgggattatctgcgaaaccgcttcggcgcgggcttgacggtgttgtccaccatctgcaacgccaccatgaaccgccagcaggaggccatggatctggccgccgccgtggacttcctggtggtggtcggcgggcgcgactccggcaacacccgacgcctggcccaggtggcccgcagtgccggaacgccgagcgtccatatcgaaaccgccgacgaactttcacccgggatgttcacgggctacgccacaatcggcttgacagccggcgcgtcaacgccgaagaaaataattgaccgtgtccagcaggtgctggaatcctattagcctcatgccggtcgtccgcccctggcggccgaccggccgacaaacgccgccccgcccctgtccggcgcggcctcaaccgcggagaacctcatggcccagaccaacattctcctggaagccggcaccaacgagctggagatcgtggagtttttcatcgacgagcccacggcctcctcgtttactgccgacgctcccgaaacgtcgggccactaccggggctattacggcgtcaacgtggccaaggtgctggagatcatccggctgcccaaggtcacggccatgcccgaggtgtcccacccaagcgtcatgggcgcgttcaatctgcgaaaccacatcatccccctggtggacctcagcatctggctcgacaagcagcgccaggacacggcctcgcccaaggtcattgtcaccgaattcaacaacgtcacgtcctcgtttctggtctccggcgtcacccgcatccaccgcatgagttgggagtcggtggagccgcccaaccgctacgtttccaagatgagcggcgattccatcaccggcgtggtcaagctggaagaccgcatcgtttttcttctggatctggaaaaaatcgtggccgacctcaacccgagcctggggctacgcctggacatgagcatcgaatggaactcgtccagccgctatcgggccctggtcgccgacgactcggtgctggtgcgcgagatgttaaaagacctgctcaacaaggccggcttcgacgttacggccgtgcagaacggccgcgaggcctgggaactcctcagtcagatcaaggagaagtccgaggccgaacaccagcccctttccaactttgtccactgcatggtggccgacatcgagatgccggccatggacggccacaacctcaccaagcgcatcaaggacgatccggtcctgcgcgagttgccggtgatcctgttctcctcgcttattaccgacaagctgcgtcacaagggagaggccgtgggggccgacgaccagatttccaagcccgacgtcagccagctggccatgcgggccaaggcgctcattgagcgcaagctcggtcagaaaaccgccgcctgaggccgccttggcctcctggccggccacgtccgtgcacttttttacgacgcgcgacgtgttgctgccccatgccccgtaaccgcctgtccttcccgacggacacttccggcatcacccgcttcgggcggccgccggcgatgtccgggccatggttcggccccggtccttccatggccgccgggacggatcaggcggtttccatgctgtgcgatccctgccgcgacctgttcgccgccgaacaggccgtctccccctatctcgtggactggtcccaggccttcgccgatcttgacccgacccaggccgcgcccgtggccctggtgttcaaacgctcgcccttcccggacgtggtggaacgctggctgctgccggacctgggcaccccgcgcgcccgccggatcgccgaactgcacctctcggccagactcaacaacgtgctgtctctcgccggagcccacggcgtcgaaattctctccaggaaccgccacgatgccggattgctggacgccgtacgccacaatctcttcacccggcttgacgatttttccaacatgtccctgtatttcctccatggacttgtgcagtcggcctttggccgcgacctgtccatcgacgcgtgccagaccgatggttccctgcccgaagcccgagaacacggcggcgcgacaggcgggtcaaagcccgggcaggcacggccggggctggcgctggccgtcaacatcggccaacacctgacgagctggggacttattcgcctcacccaggacggcggctgcgccgtggagcgcctgtttcgccgggaaacttgccacgacttgacgcgctgctgtctcacggcggaaatagccgacatcctggccaccatgcggtccgatctgggccaggcggccgacgacgtcgaggctgtgggggtaagcctggccgccacggtcatggacggtcggccgctgccggtggcccaattcggactgttcgccgcctgctccccatgggagctcgagcgcacggccacagccatccccgatgcggcctcccgggcttttccgggccggccggcggtcctggtcaacgacggccgtgcccaggccctttttgcctttcactttgccgacggcaaggcggcggcgggcgacggccatctgctgaccctgcgcctgggggcctgcccctgcgtccactgcctggacggcgacgggaacagcccgccaggatttgacgaatacggctggctggccatccgggccgttccctcacggccgggcgggccgctgttctccaccccgcgccacccgctctcccattacggcctggccgccgccgcccatgaactcgggcttttgactcgctatggcctgggcatcgaggacgccatcccctttttccacagccggcttacaggcgacgaccccgaggccgcccgggaagccgccggcatctatcgaatcctcggcgcgcacctggccatgctggccgccgaaatccacgcccaccgcccccttggcgcgatcatggtcatgggttcccaggccaaccgtctggacgggccggcgtttgccgccttaagcgacggctacgccgcctttgccgccggccggcccctggtcccggccacggtcgggcgcatcctcgtcgaggaagcctcggccgaggccggactcgtgggggcggcctttgccgccctgtccgccgccccggcctagcccgttcgccccaagcggccattgaccgtcgaaaagccggccaaccggcccgtttgaggccccgcgccttttgacactcccggccctttgtgcttaattgacctccttttcgcgaaactcgtacgcgctttggaggcgtttccatgactgattctcccgcttcgcaacacggctcggccaaaccgtccgacattcccgccgcgctgcgcctgcctgtccagtactggcggcattccctggccgccgccgccatcgtcctcgtggccgccggcggctacgcgctgtttggcgtctatcaaaagggccaggtcgaaaaggccgaggccgccctgggcgaaatcatcaccaccaaggccggcgcggaccgtgtcgccgccctggaaaccctggccaagtccgctcctgagggagccaaggccggcatctacctcgaactggccaagaccgcccagggcctgggcgattttaccaaggccgccagcgccttcgaggccgtggccaaatccgccccgtccggcatgaagaccatcgccggcctcggtgaagccgccgccctgtcgcgcgccggccaggacgccaaggccgtggacgtgctggaatccctggccgccaaggcccccaagatctttgccatgaccatcgaccgccagctcgccgtcacggccgaggccgccggccagtggcaaaaagccctggccgcctatgagcgcatgaaggccgacggcaacgtgcaaaacgccagcttcatcgacgcccgcatcgccgacctcaagggcaagaccgccggcgcggccaagaccaacggatagtccgaacgcggccgatcacggccgcgaccgtaacgctttgcctctcccccaaaaaagggagcgcggacgccgacggcggcgtccctttcatgtgtggaggattgacgcgtgggcaaggaacttctcaagaccgagggcggcgacaccctgctgctgctcggcaacgaagccatcgtccggggaaccctggaaggcggcgtgcgctttgtgacctgctacccgggcacgccttcgtccgaggcgccggacacctttttccgcttgagccagggcgcgccctattacttcgaatactccgtcaacgagaaagtggccctggaagtggccggcggcgcgaccctggccggtttgccgagcctgtgcaccatgaagcacgtcggcgtcaacgtggccgccgatccgctcatgaccctggcctacgtctcggccccgggcgggctggtgctgctgtccgccgacgatccgggctgccattcctcgcaaaacgagcaggacaaccgcatttacgcccgcctgggcggcctgccctgcttcgagccggccacggcccaggaatgcaaggacatggcccgcgacgccatgctcctttcgcgcaagcttgaaacgccggtgctcctgcgcaccaccacccgggtcaaccacgtgcgcggcccggtggtcaccggcgacctgccggccacgccttatgaaaagccctttgtcaaggatccggccaagtacgtgcccctgccggcctcggcccgggtcatgcacaaacgcctgcgggccatcctcgacggcctggtcgccgaggccgacgcctcgccctacaacgtcgaatccggcgctggggaactgggtttcatcagctcgggcgtttcgcgcaactatctctccgacgtcctggaagaagaagggcttgtcggcaaggtgcgcctgctcgaactcggcatgacctaccccttgccggaaaaccgcatcgccgcattcctggccgcctgcaaaaaggtgctcatcgtcgaggaactcgaaccggtgctcgaaaacgagatccgagccctggcccaaacgcgcggcatcgaggtcgaaatcctcggtaaaagcgaacacctgccccgcctgggcgagttctccacggccaacgtccgccaggccgtgcgtgccttcgtcgggcagcccgccgccgtggtcgatgcgctcaccgtgccgggcgacctgccccggcgtccgcccaacctctgcgccggctgcccccaccgggccgcctactacgccgtgcgcgaggtttacggtgacaccgccgtctattcctcggacatcggctgctacaccctgggctttttgccgcctttccgggccgccgacttcctgttgtgcatgggttcgtccatctccaccggggccggattcgcccgggcctcgggcaagccggtggtggcctttatcggcgactcgaccttcttccactccggcatcaccgggctcatcgacgccgtggcctacaagcacgacgtgctcatcgtcatccttgacaaccggaccacggccatgaccggccatcagcccaacccgggcgtggacaccaccatcttcggcgaaaaccccaaccctgtggacctcatggccctgatccgggcctgcggcgtggagccggtcaaggtcaatcccctcaaccacaaggcgaccctggccgccctgaccgagctgtccaagcagaccggcccgcgcgtgctggtggccgaatacccctgccccatccatgcccggcgcgtgggacaggccaaaaagaccctgcccgcccgggtggccggcgatcccgccgcctgcctgaccgtgcgcgacaatctggcctgcccggcctttgccatggtggacggccagtttaccatcaacgccgaacagtgcgacggctgcatgttctgcgtccagctctcaccggacctcaagcccggcaagaaggaggcgaaatgacccgcgcccgcatctttttcaccggcgtcggcggccagggaaccttgaccgccaccacccttcttgcccgcaccgccctggacgccggcttgcccgtcacctcgggcgagatccacggcatggcccagcgcggcggcgtagtcgagtccaccctgcttgtgggcggctacaaaagcgccatcatcgccccgggcgaggctgacgtgatcctgggcttcgaactgttggaaaccctgcgcgccctgccgatgcttaaacgcggcggctttgtcgtcggcaacagcgaagccctccagcccgtgggcgtgtgcctgggccgggagtgctatccgccccttgaggccgtgctggaaaccgccaagggctttgccgcccaggtggtgctggtcccctgcatcagcctggccgaacaggccggcacggccaaggccgccaacaccgtgcttttaggcgcggcggcggcctgcggcgcgctgccgtttagcgtggccgatctcacccgctccattgagaagtacctgaaacccaagctggtggacgtgaacctcaaggctttggccctgggggccgaggccgccaaggcgggccaggcggcgtgatcgattccttgacgtctttcgacggggctggaccggcgttttacggcgcgctgtcgcgcatcgtggcgctgaccggccccggccgggcggtgcggcgcggcctggaaaacgccctggccgtgctggtcgaggccctgggctatcgccgggcctgcctggagctccacgatctgccccagccgggggcgcgcatcgtgctgtcccacggccgccagcagggcctggaccatctctacggcccggcccccatcaccatgggccaggtcatcggctcgcgccgctcgctcatcctccaggacgtcaaggaccatcccgacttcatcggccggccgcccgaggagctctccaacctgtcccacatctgcgtgcccgtcaccgtgcccatgcccgacggccatgtggaaggctttgcccctgtcggcccgtccgacgtcatcggggcgctcagcgtcgatctgcccaaggcccccatggtctttttggaggcacaccgcgaatttctggccgtggtcggcggcatcctcggcaacgccgccctgcgcttgcgcgacgagctcgacctgtcccggcgttccgtggccgccgctgtccagcccgtcggcatcgccgccgaggaccccgcgcccgaggcggctccggcccagcccgtggccgtgtccaagagcattcgcctggtcctgcgccagatttcccaggccgccgattccggcgatccggtgttcctgcgcggcgaggaaggcacgggcaaggaatgcctggcccgctggctccacagccagggcaaccgccgccaccggccgtttctgcgcctgggctgcggcgaaatgccgcccgaggcggtcatggaaacgctttttggcgtccaaaagggcgagcgttccaagtccacccgctccaagcgcgggcttttcgagctggcccagggcggcgtggtctttctcgacgacatcgaggaactgtccctggaggcccagtcccgggtgctccaggtcatccaggaaggggccgtggcccgcatcggcagcgacacgccggtggccgtggacgcccgggtgctggccgccagcaccgcctccctggaagacgccatggcccagggcgacttcctcgaagacctcttctacggcctgggcgtgtttccgctctacgtgccgccgctgcgcgaccgcatgggcgacatcctgcccctggccgaacatttcctggaagacttttcccagcgcaccggcaagagcgtgcgccgcatctccacgccggccattgatctcttaagccagtaccactggccgggaaacgtccgcgaactggccaactgcatggagcgcgccgccactctttgcgacgaagccgtggtgcgcacctaccatctgccccccaccttgcagaccggcgaatcttccggcaccgaaccctcgctgtcctttggcgaggccgtggccaagttcgagcaggaactgcttgtcgaagccctcaagaaggcgcgcggcaacatgtaccaggctgcccgggacctgcgcgaaagctaccgcgtggtcaactacaaggtcaaaaaatacgccatcgatcccaaacgcttcactccgggacgacgcggctgacagaacacaaaaacggtttacccactcccggcaaacgcgtagaaactgacgtcacttcaccgccccacaggagggttcatggcaagcctcgccagtcacgattactaccgcgacgacatgaccaaaatgccgccgctacgctccatcgcccagaccctttgcctggacaaacgcgtccgcaaggtcacggccgccgaggcctatgagctggccaagcgtcagcacgacgtcatggacaccgatctgccgatctacccggcggcggccaagcgcctgggcctgcccgaaggggccaccgtgctcaacaactgccacggccgcatcgtcggccgcacggccctggcccggcgcttctacacccgcatggaggccgtggagcggcgcaaggtcgagtccgacctgcgcgaagccgtctacgccatgcagcgctatccgctgatcaaggccgaagcgattctcggcctcgacaccgacctcatgatcaaggccaccatcgtcggcaccgaggacgacgcggtcaacatcttcaactggctggccaatttcacgccctatgaagagctgaccgaggcctacgccaaaagccccaaactgcccattcccgacatcttggtggtcggcttcaaccaatggaccaccaccgacccgtattaccacaatgccggcggctcccagctggccctggtcgacgaagacgccaacgtcatcttcaacctcgggatgcgttacttcggcgaacgcaagaaaggcacgctgaccctggcctggacctcgggcatgcgcctgggcctggccgcctgccacggcggcatcaaggaaatcgacttttccggctgcgccgacgccaaggcccaggacatgggcaagcgctccatcgcctttttcggcctgtccggcacgggcaagtcgtcgcacaccaactcccacgacaacggcggcaccctgccggccgggttctccaaggtggtgctccacgacgacgccttccagatcgactgcgagaacaaggtctgccgcgtctgggaaccgaccctgttcgacaagaccgattcgcgccccacgggccatcccgactggcgctacatgatctccaccatgaacctgggcctgaccgaggtcgatggcaaggtgttgcccctgggccaggacgtgcgcaaccccaacggccgggcgcttattgaccgcgacctgctcggggcctacgtcaaccgctgctccttccccaacctcatggtctggctcatgaaggacacctgcctgccgccggtggtgcgcttcaccgacaagcatctggccgtggccatgggcgcttcgctcatgacccgacgcaatctggcggaaaacgtcagcgaggaggagctcaaaaagctcgtcttcgagcctttcgccaaccccttccgggtgtatgagctgtggaaggacgtggaagccttcgtcaaggtcttcgaggccggagccgtgggctacacgttcaattccgtgggcttctggaagacttctgatcgcgagctgcagaagattccgctgcaaagctcgttgaccctgcaaaccgccctgctgctggagcgtctggagtgggaggactgggatctgctgcccggcgcccagctgcccaaggccgacagcgtggaaaagctcctgcccggctacgccgcgctctacgacccctcccgggtggaaaaccgcgaccgctacctggaaaccctcaaggaccgtttccaccagcgccgcgtctatctgcaaaattccgacctgcacaaccggccggatctgctcatgcgcctggtcaacgccctcatggtgcgggcctaggccctggcctggccgcctgacgctacagaaccagaccgccgcatgaacccttgcacggcccaccgccatgaccgccggccgcaggctccctccgggagtcctgcggccggtttcggaaccacgccatgagcctgcgctccgttttgggcctaatcgggcttacggtctcgctgccgtttctgggctatctggtctacatcagccaggccaaatccccgtctcccgaccagatcatctttctggccttcgccttttccgtcaccttccccacgctcatcctgctgtcgctggtgctcttccgcagcttggtgatcctggctgcggcgctgccggtctacgccgcctgcgtcatcgccggctacgcccgcacgttcatggccttccagatcctgtgtaacggcaaaccgacggaatccttccgcgattgcctgtatttcagcgtgtcgcagttcaccaacaccggctgcgccgactgcgtccccacggcccagttgcgccttttggccgcttcggaagcctttttcggttatctgtcgctgggcgtgttcaccgcctgcctcatcgtcatcctggtgcgcatgatcaccgccgacaaactgcgccaatagtttgcccaccgccaaacggggccgcgtcgcgaccccgttgtctcgtcttagccttgaagctgtctccgtttagactgtctccttggtcacccgcacccgggtgctgctgaaatccgggatgccggccacggcgtcggtcagcggcgtattgcccagggtcggatcgagccgggccacgtcgttgggattgatgccggcccggtaggcttgcctgggtacgagccggtcgccgtcggcgacggcggttccgcccaggaagaccgaggcggcatccttgacggccagggccgtgccgccgaactgggtgtggccgaaatgaaaggacaccgccacgcagccgggacgcaccatgcgcgtgaggtgcagccggccggacacgccgtcgggattggaggccgaggccaggcggacccggtcgccctgggccaagcccagcccggcagcatcgtcgggatgcatctccacggcgttgtccggcacgatggctatggcccgggaataccacagcgagcgcgactgggtgtgcagatggcgcttgtaggtgacaagggtcagcggatagtcgcggtcggtatcggccaggtccgcgccgtccccggtttggggcggcatccagacaggcgtgcccggcaaccgccggccggtcatggaatccttggttcgggccagggtctcgttatagaccatgtagcgctcgatgccgcgcgtgaaacgctctccctcgaacatgtcctcgtaaggcctaaaaaccccgccccgagccaggatgcggcaaacggcccaccactggtcgtttgacagcaggccctggtggtcggctatcggatagttgccctccacaaaggccacgtcggcgtcggtggccggcttggccttggtgttgtgggccaggttggcgaaggcgcgcagatagaagtcctcggccgtgcgcaacggatgggacgcgccgtcggcgccgggaatggcggcgtcgccgaagccgggcaggttcaagcgcagcgccagatcaatgagcaaggtttccgtgccaaacggccggccatcggcggtccggccggtcagcggctccatcatgggcgtgcgcactgccgtgaaccgcagggccggggcatggggcgtgagccagccatggtggccttcggggtagcacaggtcgggcacgatgtagtcggcgtagatgttggtctcgttgatggccgtgtcgagggacacgtgcaagggcgtgcgccctggatcaaggagcgtttccttgaagcgcgagccccccggggcggaatagacgccattgtagagataggtgaaaagcacctgggccttgtaggggtagccggcgtccaggccgatgagagcctcgttggacaggccgccggcggaaaagggaaaccagggcagtctggccggatagggattggctccagcggcttttttcttcttgtactcgctggttttttcataggcgaatttctcgcgggaaatcgccgcgccgccgggtttgcgctggcccgggaattccttgagattgtagagccctgtctcgcagtccccggccccgccgccgcccttgagatagccgccgcgcatgtccgggctcccgaccagggccgagagcagggccacggcataggccgcgtggacgccgcagatgtagttgccggccccgtggtactgggtcaccgcgccgcgggtgccggcggcggcgaagtcccgggccacccggcgcagctcagccgcgtccactccggcctcggcggcgtaggtctccacggagtgggcctcgatgccggcccgtaacatggtaaaggcggtttcgacctgccaggcgttgccgaaatagtcggtagccacggccttgccctccagcacggcctcgcccgtggcctcggccgcgaccacccggccggcggcgtcaaggaccatgagcgtttcgcccgcctgaccgcccttggacggatcaatgtccttgaggcgcaacatgcggccgttttccggatgcctgggatcgacgatgaccagacagggcgcgttggtgcaggaaccaaatccccgctgccgggcctccttggccgagggagcgctcagataccgcaggttgcacaggttttcgtccagcagggtccgggccagacccagggccagggccccgtcccggccgggacgcaccggcagccaggcgtcggcgtgaacggcggcccgggtggcccggggatcaatgaccgcgaagcgcaggctgccctcggcctgcctgcgggccatgagcgcgccgtaggtgttgatgccgggttgcagggcctcgtagacattggccccgaagaccaggatgtaggcggccgagagcggatcggccttgagctcgatctccttgccatgggtcagggcgaaattgcccatgcgaaagcccaggccgcagatgtcggtatggccgatgcggttggcggagcccaccgcgcccttgacgaagcggtcgatgaactgctggcggccggtctgcagacggccggtgacgaagaccaggccattacggcggctgcccagctccggcgcggccggatcaatggggtcatcgctcaacagctccttgatgcccggaacctgacgctcctcgccgatatgggcgaagtggcggccgccctcggcgatttcggccaccagccgatcccattcgatgggttcgaactgccccgagccgcgtgggccgcagcgcttgagcggacgcacgaggcgataggggctttgggtatggttgaccgtgtcgtggcacttgccgcacaccgggctcggcacggccagggaatccgccgccggcgtgtcctggtcgatgggggcaaaggccatgttgtagggatggtagggattgcccgaaacccgttgcagccggccgccgcgcacctcgccgcgcacaccgcacacggcgttgcaggccaggcacacggaatgaaccacccgggtctcgtcgccggccgggggagccgccccggcctgggccgaagcggcgtcgccaaggatcgtcccggcggcggccacggccgcgccctggccgacccggcgcaggaactggcgacggttcagtgcgccctgaccgttattctcctcgcgcgtcatgacgcctccttgcgtttgcccggccggtacagcacggccccttcgagcccaagctcgggcctgtgcggctgcaagccgccggcggctagctggtcggcaaacagcccagccgggctgttgcggtcgccaaatgacctggccccggtaggacaggcctcaacgcaggccgggacatgccccttggccagacgttcccggcagaaatcgcatttgtcgaccttgccggtgcggctgtcgataaaccgcatgccgtaagggcaggcggtcacgcaggcccccgcgccggtgcagcgcttggggtccgtgaccacgatgccgtcggcctcacggcgcaccgcgccgttggggcagaccgccaggcacggcgcttcgcggcactggttgcacaggatcggcaggaagcgcagcacggcaaaggcaccggaggcgtcctcggtctcctcaatcttcgtgggaaagcccccaggcatggcgtcgttagcctcctggcaggtcaccacgcaggacaggcagccattgcagcggccaagatcaatgatcatggcgtagtcgggggtcggcacctcggcggccaggcctgtcgccggcaggacggcagcggccaggcaagcgccaagaccctggcgcaaaaccatgcgtctggtcggcatggagtacctccttggcaacggccgcgcccaggcacgacgcggccgtgaggggataagcgggtttcgtgcggcatccttgaaacggacaggagccgtttcgctggagccgcgcgaaaacgaagaagttcccttaaaccatacggccccggcttcagggatgcagggatgcgacgttagtcggccttgaagtcaaccgtgtaggtaaaggtcttggggctgaagaaatccagagtgcggccgtcaacctgggcaaaggggtacatgtagtaggtcagcggggggccggcctgcttgggagccagggtcacatcagtggtcccgcgttccagggcgatgcggaacaggtcgtccccgccccagaaaaactccacccactgtttggcgtccttgagttccagcttgttgaccagcatcatcttgcgcacatcagcgggatcgaccggaacccagcccgtgcccggcagatagaattccacccaacagtgatagtcgcccgtgatggctccggtcttgggggcggccatgcgcaggccgtaaacgtcgcggcaggggatgccggcggcccgggccacggcaacaaagacggagctgatgtcggcgcatttgccgccgccgttgcagctggacagcgtgcggcccggctggcccaggccgcagcccaccacgtcgttgtcgcggtaggtgtgggcaatgacccattcgtaaacgccgcgcgccttggccagcgtgtccttgcgccccttggtcgcttccttggccatggcggcaaaggacttctcctcctggggcgaaaggcccacttgcttgagatagggcacgacctcggccggaatggggccgccgttgtccacaagccggggcagcttggcgtaatgggagtcgacatgaaacgacagcgtcaacttgggctgttccttgggttctttccactcggcgtagagcgagaccccgccgctggccggatcgcggtagacgccggactgctcgaagttgcccccaaggcgcacgtcgccgatgtcctggttggcgtcggacaggggatacggcagccacaaccgcacattcttggcgccggcctcagcctggacgtcgatcgtgtaggtgacggtgccaccgcgcaccgtttcggccagggccggagtggacaaggcgacaagcaacaccagggcacaggcaaaacgcaaacgcatgagacctcccaacaagggcaataggattcacgatcaccaattcaccagggaccgtgccttatgccacaggcggcaggcggttcaccaatcgtttgttgctatcgcttccccggccatgcatcacgaagcgtcataatacgcgtcaggccagggcgtcggtcaccaccgccttgcagccgagcgtccggcgcaccgggcagcttcgggcagcgcgcaggatgcggcggcggtcgtcgtccgtcagatcgccttcgagggtgatggcgcaggcgtaggccgccgtttccgggtccgaacggtcgagggtcacggtcacggcgacgccggccaagggaataccgtggctggccgcgaacttggtcatgaccatgaccaggcaggagcccagggccgcctccagcagctcgtggggccgaaagccctggccggccccgcctttgtccggagtggcgtcgcacaccccggtgaattggccgttgccaaaggccacctgcaagggcgtggaaagtcctcggcattgcatcatacgcctgtctccttttcccgtttagtgacttaatcgccaggcaatagccagcaaaaaagcccctgccgacagtcgccggcaggggctttcccgaggttttgcaccgtttacagcgttgcctcagggcttgacgcggtagaggtaggccttttccggcaaaagatactttccggccagttccttaagcgtttcggccgagacctgctgggccgcctcgacttgctggcgctcgcggtccaggggccagccccgggccagagagttggccgcttcgttgctgcgagccttgaggctctggcgttcgcggtagtagtcgccggccatgacgtttttggcgcgaagcatgagttcatcaggcagcggcgtggagcccagctgctgcgccacctcggtaaagccggtccgggccgcttcggccttgtccggggacgtgccgatgtaaaaggccaggaacccggcctggggcgactgccacaggaaggaggtgacggagtagccaaggttttcgccgtcgcgaagccgggtgaagagcaagccggattggccggccagggtttcgtttaagagcgtcagggccggcgtttccggggaatcgctgccgggtaccgggaagatcatgaacagatgttcctggttgcgctcggtgagcgtggccgcgccgtccttggtctggccccaggccggcacggggaaggcgaagggcttggccggcccggcggccttggccagggtttcggccagccgacgcacggcggcggcgtcaaaatcgccgcaaacggccatgacccagggcatggcctgctggtccttccagaagccggccacgtccttgggcgtgaacttggccacggcagcggcctggccaaggcgcatgtagccgtaaggggaatcaccgaacaaaaacgggaagatgcgccggaaggccaggcccatgggctcgtcttccttggccttgatggcggcgagctggtctttgacgtcccgggcaatctcagccggggcaaaggccggggtggtcagcacctcggcgaaaaggccgtacaggtcggtctggaagcggctggggaaacgcgccccgaccgagaaggaatcgcgacccgaggcggccgagatcgaggccgaacggtcggccaggaagtcttccacggcgttggccgagcgcttggccgtgccgctggtcaggctgctcgaagccagctccgccagcccttgccggtccttggctaaaagggcgtcgccgccgttatagaccatggagatggagacatagggcagggtcgtatcgggcagcaggaccagggtgcggccctggcccagtgacacgacttccgcgccggacttgtcggcggcggcgacgggggcggcctcagccgtcttggccttgggccagatgcgtccggccgtttcttccaggccggcgacggtgaccacggcttcatcggccttggggaccagggcggccacggtcaaccgctcgggacggaaggtggcggtaatgacggcgtcgaggctcttgcggtcaacgaactgcaccgcgcgcaggtagttggcctcgccgcccggctcgtaaccgtaaaactggaagtagccggccttcatggccaggccggcaagggtctccttggctccgaaaagaccgtcctcggcgttgcgcttgactcgctcaatttccttgtcgctaaaggccgcgccagagagcttggccagatcggccataagtccctgccagaaggcggcgacgttcttggcgtctagggtggcgtcgataaggaacagcccggaacgctccagggtcatggcggcgcaggaaatgtcgtccacgagctgcttgtcgtacttgaaggcgcggtagagccggctggtctcgtcgccggccagcagtcccgagagcacgtccagggcggcctcgtcagcgctgcgcagggccggcatggggaaggcgacctggagccgcaccttgccccactggccgtattccaccgccaccgatttcgtgagcgtcgcaggcgcggcatacagggccggcggggtcacgctccggtcgtttcgcaggtcaccgaaaagcgccccggcttccaggagcacctcgtcggcgcgcaccttgccggccaccaccagcagcatggactggggctggtagcgctcggccacgtagtcacgcaggtcctggtcggtaaagcccgaaaccgtctcgggatagccgatgaccggccggccgtagccctgccccggccagaccaggccctgggtcagctgaaacaggcggctgtccgggtcgtcgcggccacgggcgatctcggagagcaccacctgcttttcgccgtccagttccgacggatcgaacttggccccaaagatcatgtccttgaccacatccaggcccaaccgccagcgctcggccggcagatcgacccgataaatagtgctgtcaaagctcgtggcagcgttgagttccccgcccgcgccttcgatgtccgaggccacctggccggccggccgtttttccgtggacttaaacaccatgtgctcgagcagatggcttaaccccgcctgcttgggcgtctcataggccgaaccggcatggacgaaaagccgcaccgagaccaaggggaaccggtcgtcctcgatggtcatgacggtaagcccgttttggagcctggccaccttgggggcttcggccgcgaaggcggccgtggacaaggtcacaaggaaagcgacaaggacggaaacgctgcgccaacgcatgggataaaactccttcgtgcagccgcccgccccgggacggggcgggcgcgacactgcaaggtgcgggcttttggcaggaaagggaacttaaaaaagcttcacgaaaggggaaaaacaccgccgtcggcaaaggatacggtggtcttttgcaagtcgtagcgcccccggacaagcccgggacagaccgcttcgaccagccgcagagggcttaaataggtctcggaaaaatcgcaggaaaagcgcacgcagcccgggccggccggctgcacgccccgcaccacggtcttggcgtccagggtgcgcggccctttcttggattcccaggtcacagggaaggcggcggccgcctcgaaagctgcaaaaccctggcggcaggcctcagcctggtcgtccgacacggtcagctcaaaggtttcgaccaccggatgggccaccttgcgcccgccggtcagctcctccaccccgaccacggtcaagccctcgggcagattggggttgaggcgcgcggcgaattcctcgggcgcaatgggttcgcgcaaaaaaatccccatccactcggcccggctggacacgccaacaggcaaggcccggccaaaggaaatctggggcagcggatggtagccggccgagaagctcggcttgaggccggcccggcgcagggagcgttcgatgacccggccaagctccagctggcttaagtagatggcgctgccttccttggcgtaccagacccgaaaatgggcggccttgcgggtgaggtcctcccggggcggggccggcggcgcggccacggcctcgcgctccagggccggacggttgagacggggcttgatggccgtttcggcggtcaggggactcttgcggccggcgtcgttgcacacgccgcaaccggtgcagtcgccgaaacggcaatcggccgtcaccgtgccggacagcgcccgtttgcgctccagacgcaaataggccggcgacacgccgcaggacagatggtcccagggcagcggcttgtccaccgggcgctcggccagccagtcggccgggtcaagcccggcctcggcgaaaatctccagccacggggccagggaaaagcggtccacccaggagcaaaaaagcgcgcctttttgccagccggcctcgaccaggggagccagctcccggccggcccgggagaacacgccttccagaaagctcatctccggctcgtgccagcgcagggtcagccggcggtcgctggaaaaaaggtcgcgcagatagcccacccggcagcgaatctgctccaggttgatctggccatgccactgaaagggtgtgtggggcttgggcacgaagggcgagatggcggccgtgacctggaggcgcttggtccccttgggggcctgggccagcacctttttggccagctcgaaaatgccctggacgtcttcctcggtttccgtgggcagcccgatcatgaaatagagcttcacctgctgccagccgtgttcaaacagccgggcggcatgggagaggatgtcgtcttcggtgatgcccttgttgatgacgtcgcgcaagcgctgggtggcggcttccggagccatggtggctccggtgcggcggatgccggccatcatgtcgaggatggacccggacagggtgccggcccgcagcgacggcaaggacacggccacctgctcgcggcggcagcggtcgatgctctgggcgaaaaggctttccagggccgagaagtcgccggtggaaagcgacaggaaggacagttcctcgtagccggtgcgacaaaggccctcgccgaccaggccctcgagggtggagaggctgcgttcgcgcaccggacggtagaccatgccggcatggcagaagcggcagccgcgggtgcagccccgggcgatctccaccgagagccggtcgtggacagcctgggcaaagggcaccacctggcaggccggaaacggtgccgtgtccaggtcggccacgatggccttgtccacccgctcgtagccgggcaacaggcttcgcaccccggtttcggggtcaaactcgaaaaattccggcacgtaaaagccgggcatggcggccagggtctccaggagctggcggcggtctgccccgctctcccgggcgtcggctacggcttcgagcagatcgacgatggccttttcgccgtcgccaaggaccatgacgtcgaaaaatggggccatgggctcggcgttaaaggcgcagccgccgccggctaccaccaggggccagccgccctgcccggcccgctgggcgctgcgaaaaggaatgccggccagatcgagcaggtggagcacgctggtgtagcacagctcatgggtcaggtgaaaagccaccacgtcgcaggcggcaaggggcgtgtcggactccagggtggcaagcctggttcccgtctcgcgcatgacggtcacggcatcgtcggccggggcaaagacgcgctcggcggccagtccctcgacccgattgacggcttcatacaggatgcgcccgccgacataggacatgccgacttcgtagaaatccgggaaggccagagccaggcgggcgcgcacggtggacgagtccttggccgtgcggccccattcgccgccgaggtactgggtgggcttttggatacgggaaacgagctcgcgcatggatggtctccggccggcaaaaggccggggggtcgtggccagacggccaggaaaaaggacgcgccgccgccgggaagaacccttaggcggcggcgcggacaaacaacttatttcttgagcagattcgagatgttgccgcccttgccagccagggacgacaaattcttgaggtcgccggtggtggacagggtcagattgctcgtggcctccagatagcgggtctggagctcgtcggggaacttcttgaactggtagagaatatgcgcgccgtcgatctcgcccccgatctcggtttcgaaggggtagccgaagggcagaagcatcatctgcacgccctgctgggagggaatggtctggagcagcgcgatttcggtaagcttattggcggcttcgtcccatttgcccaggacggtttcgccgttgatgagtttgaccagtcggatgtcgtaagccatggggcattctccttgatgtccggcgctacgcgccaagcgttgaaatcgatacggtattggcttttgtcaaggccggccgagcgctattcgttgaggtcgaagacggcgaatccctggcttttgcacagcgcgtcgcgctcggcgtcgcgcaggtcggcgcgcaccatttccgtgaccatctcttccagggtgatcttgggcacccagcccaggcgctcccgggccttggtgggatcgccaaggagcgtctccacttcagtggggcggaaatagcgcgggtccacggccaccaggcaattaccggtcttggcgtcgtaacccttctcatccgcgcctgtgccctcgaagcggatggagatgccaagctcggcagcggccatcttgacgaagtcgcgcacggaatgctggcggccggtggcgatgacgaaatcgtccggggcgtcctgctggagcatgagccactgcatctcgacgtagtccttggcgtggccccagtcgcgaagggcgctcaaattgccgaggtagaggcagtcctggaggcccagcttgatgcgggccatggcccgggtgatcttgcgggtgacgaaggtctcgccgcgaaggggggactcgtggttgaaaaggatgccgttgcaggcgtacatgccgtaggcttcgcggtagttgaccgtgatccagtaggcatagagcttggccacggcgtaggggctgcgcggataaaagggcgttttctcggtctggggcgtctccacgacctggccgtagagctccgaggtggaggcctggtagaatcgggtatgcttctccatgcccaggatacgcacggcttcgagcaggcgcagcgtgcccagggcgtccacgtcggcggtatattccggagactcaaaggacaccttgacgtggctctgggcggccaggttgtagatctcgtccgggcggacctgctggatgatgcgaatgaggttggtcgagtcgctcaggtcgccgtagtggagcgtgaacttgcggccgatgtcgtggggatcgcggtagagatggtcgatgcgctgggtgttgaaaagggaggcccggcgtttgatgccatggacttcatagccttttttgagcagcagttcggccagataggccccatcctggccggtgatgccggtaatgagcgcgactttacctttcatttctggagaatctcctgttgttcgtggacggccatggcccgggccacgtcggccggccccatggtcgccttccagcctagcgcctgcgccgccttggccggattggcccgactgacggcgatgtcggcgggccgaaaaagtgtggaatcgacctgcacgtggtcctgccaatccaggcccagggcggcgaaggcctcggccacgaactggcgcagggtgatggtctggccggtggcgatgacgaagtcttccgggacgtcctgctgcagcatcagccacatggcttcgacgtattcccgggcgttgccccagtcccgggccacgtcgatgttaccaagcaaaagcgtctcgcctgagccggcggcgatgcgagcggcggcggccacgatcttgcgggtgacgaaacgcttgggccgcagcggcgactcgtggttgaacaggatgccgttgcaggcaaaaagcttgtaggcctcccggtagttggccacctcgaaatgggccgccgccttggccacggcataggggcttcgcggggaaaagggcgtcagctcggttgccggctcgccgccggtgtccccgaaacagtcgctggaggaggcgtggtaaagcctagccggcgcgccgagaaagcgcacggcttccaggaggttgagcgtgcccacgccgatggacatgaaggtttccacgggctggtcaaaggacaggcccaccgaggactggccggccagatggtagatttcgtcgggcttgactttggccaggacggtcaggacgctgcgaaaatcggtcagggtgacggaatggacctcgacctgttcccgaatgcccagcgccgacagactggccagggaagccatctgggcgtcgcgggaggttccggccacccggtagcctttctggagcagaagctgcgccagataggctccgtcctggcctgaaacgccaaagatgagggcttgcttcatatgcgaaatggcatccagggaggggcggttacgcgtaagcgcatcttctaggagtttccgggggcggcgtcaacagccgcgcctgccgggcgactctcgtgcccccggcaggcggcgcacacgccgtcgatgcgcacctccacagacagcacgtccatggccagcccggcgcccagggcggccacgtcggccagcccggccccttggggcagacactgcatggccccgcaacgcacgcagtaggcatggccatggggcgctccggcggttccgggctccaggcagtagcgctgggcccggtccccggcgctgtggcggcgggccagccccttttccaccagcagatcgagaatccggtagagcgtcacccggttggccggacgcagccgacgcaccagggccaggatatccccggccggcagcgcccggcccgccccggccataaccccgaccacggccagccgcagcggcgtggcctcaatgttggcccgggccagcatccgggacgggctttcgccgagcatggcgtccacggccggcctctaggcgccctgccgccgccgggccaggcccggagccagggaaataaagaacgtgccggcggccacggcgatgatggccgcgcccgaggtcaggttgaaggcataggccagccccaggccggacaggcaaaacacgatattgaggagccccgcccagaccatggcccgccccagggaggcggcccggcgcacggccagactcggggccacggagagcagcgcaatgaccagaatgaggccggccacccggataagcagcaccaccgacacggcggccagggccgtgagcaggcaatgcaggaacatcaccggcaccccgcgcacggcggcaaactctcggtcaaaggccatggacacgaagccgttgtagtggcgcagggcggcggccaggagcaccacgtccaggccggccagagcgtacaggtcgctgtccggcacggtgatgatgctgccgaacaggtagctcatgaggtcgggtttgtagccgggggtcagatccaaaaggataatgccgaaagccatgccggcggcccacagcacgccgatgacggtgtcggtgtcctcgacgcgccttaacgtcacggcggccatggccagggcggcggccacggtgaaggcgacggtgacgggcagcacgggcagggccaggaaataggccagccccacgccgccataagcggcatgggccgccccgccggccaggaaaaccatacggttggccacgaccagggtgccgatgacgccgcagcacacggcggccaaaagcgccgccagggcggcgttttgcataaacggcagggaaagcgcttcgatcatggccgctccatcggggacagccgggcgaggtccggcggaatgcggcgcagataggcgtccatggggcaggcatggctgtgcacgccgtaaagcaggtcaagcatttcctggctcaggcgcggttccggggaataggccacccggccgttgacgcaggccacggccgtgaccccggcggccaggatgctcaggtcatggctgacgaccagggaggtgacgccctcgccgatgcgcgagagcacttcgtacaggcagaacttgccctgagggtcgatgttggccgtgggttcgtcgagaatgagcaggcccggatcggaaaccagggcccgggcaataagcgtgcgctgcttctgaccgccggagagctcgcaaaagcggcgctgggccagcccggccatctcgacccgggccagggcggcgtcggccttgtccaattcctcggacgtatagcgaaagccgcgccgcccaggcgacagcagccccatgagcgccacttcacgtacccggatgggcagatccttgcgttcggccaccccgtccaggcgctggggcacgtagccgatgcgggcgctgtgccgccccggttcctcgccgaatacccggatggttccggcgcttggcgtcaggatgccgaggataagctttaacagcgtggtcttgcccccgccgttggggccgagcacggccagacgctcgccctgggcaacggccaagctcacgcccgaaagcgccgcctggccgttgtaggcaaaggtcaggtcgcggatatcgacgaccggttgcgtcacttggtctccgtcttgccggccagtccctggcgcagggccgcggccgcgccgcgaaggctggccggccagtcctcggccagaggattgatggcggcggtggcgccgccgatgcccttggcgatggtctcggcctgggcggcgctgagttgcggttgcacgaaaatcaccttgaccccgtcggccttggcttccttgatgagtccggccagggccttggggccgggttcgcggccgagctgctcgatgggaatctgggtcagcccgtagtcccgggcaaaatacccccaggacggatgaaacaccatgaatttgcgctgcccggccggcacatcggcaaatacctttttgatctccgcgtcaagggcgtcgcactgggcggccaagcgcgcataaccggcggcgtagtcgaccgcgccgtcgggatcggccttggacagggcgtcgcgcatggacgcgccgatgaccttggccaggctcggcgacagccagacatggggatcgggctcgccgtcatggtgctcgtggcctgtttccgccttgccgtggccgtggccttttttccccttgtcatgatcgtgatcgtcgtcatcgtgatgggcgaccatggggatcttatcgatgccggcatcggtcttgacaatggccatcctggggttggccgccgcgaaccggggcagccaggcgtcctcgaagtccatgccgatggcgaaatagaccgccgccttggacaggtcggccagttgccggggtttgggctcgtaggtatgagcgtcggacccgggcggcaccatcaccaccacctcggcccggtcgccggcgatctgcttcaggaaataggcctggggcgcgatgctgaccgcagccaggattttggcctggactggcgcgacggacatgaaaatgatactcagaatcataatagtcaagcgttggatcatggcagctccttggcgtcgcctggacgcacaagaagcaatgcaacaaagttgcatcgcaaagtcaagcccgcccagcccaggggcggcaacaaaaaccttgaattcccagggcaggccctttaccccaaggcagccatgaccaattacgcaccaccgcctgccgcgaccaagacctcggccctggccgtctgggggcttattctcctgacggccctggccgcctggcatttcacggcctgcttcctgccctggtacacgagccagcgggccgagcacttcgccagacgcctggacgacctgtccagcctgcgcgacgccctggccgcctttcacgccaaatacggccgctacccggccaacgccggtttcgtcggagccattggcatcaagggcgaggtcaacggcgactggctgccaggattggccggggaattcctgcccgccctgccccgcgacccggccggcacgagcgatcccgacaaacagtatctctaccacggcgacggcgcggactacaaaatcatcgtccacggctcgggcgactgcgccctggcccgcaaggcccatcccgacatggtcgatccaacccgggactgctgggcttatggcttctggacgcccggcgcggccaactggtgacctccatgacgcagctccagaactccgctcccgcatcgctcgtcgagaccggccgccgcttgcgcgattggctggccgaaacctttttgctgcgcggcgcgcgcattccggccctggacggcattcgcggctgggccatcctcatggtcttcaacgtgcatttctttgcccgttaccagccgaaattctatttcaccgaacccggcggcgccccctggacggccttgaccatcatccattccggcagtttcggcgtggacctgttcttttttttaagcggcctgctcgtgtataaaagcctcatggccaagcccgtcggggcgttgcgcttcctctacgaccgctaccgacgcctgctgccggtcattgtcttcgtcaccatctatgtggccgccgacacgccgcccaggcggcttttcgacaacctctttttcctcaacatctttgacgagccgcccatccatttcttcacctggccgctcgtctatgaaatgtatttctacgtgctgtgcgcggccgtgttcatcggctgccggcggcttcgattcgtttccggctggccgtttttcttcgccctggtcgcggccctggtcgtgtgcgagttcgaggtgcgctttcgcatttccttcagccggttcctgggctttttctggggcgtggccctggcccggctcctggccggcgaggccggccgccgcgccctggccgccctgccctcctggacctgggccgtggggttggggctgttgctctattgccgctggctgtggggctcgggctggttcatggccgccggcggcaacgagcatctcaagaatctgctctttttcagcgccgtcaacgcctcgctgtttctcgtcaccgcctcggtcatgacccgggcctcgatcctgtcccgcattttttccttcacgcccctgcggtttctcggcatcatcagctattcgctgttcatgacccacatgctggccctgcagatcacccaaaacgtggtcggcatcccggtgacgaacgtctggtccatgctggccaaccacgccgtcaccgtcctggccgccacggggctggccatgttctcgttttattatctggagcggccctatttcgcccgcccggcttccccaaaacaggccccccctcggtaatggggccgtcaggagacatcgcgccatgccctacgcgattccaggcttgaccgccggtcaagcagcccctctgcttctcatttgagttcaaggccctgcgtggggtgcggctggtgttgcctggccgatccctgcgtggagtcccacatccgctacggctaccgtcgccggtgtcccgacctcgcctgggacgaagcaaccggctgctaccgctgccggttggccgaagaccctgagcacggcgaacgtttccggtttctgctcggcgtcgggcacggctgctgcgcgccgctcaacgcctggcgcgacgacgtgcgcaatcgtgacgatcccgagacgacaaatgacgattgaccgccctgacgcccttgccgccgcgccaaaaacattctaggaaatgacggggtttcattccaaggaggaacgtatggagtttcgcggcgcaattacggcgttggtcacgccgtttcgaagcggcgaagtcgatgaggaggctttccgcgccctcatcgaatggcagatcgagcaaggcatccatggccttgtcccctgcggcaccacgggggaatccgccacgctgtcccacgaggagcacaaacgggtcatccgcatctgcgtggaccaggtcaaaggccgcgtgcccgtcctggccggggccggctccaacaacacccgcgaggccatcgagctgacgcaggacgccaaggacgccaaagccgacggcgcgctcctgatcaccccgtattacaacaaaccgacccaggccgggcttgtggcccatttcaaggccatcgccgaccgggtggacctgccctttatcgtctacaacgtgccaggccgcacggccgtcaatctgctgcccgagaccctggccatcctcaaaaaagagatccggcaggtcatcggcgtcaaggaagccaccggcgacctcacccaggtctcgcgcgtgctggaattttgtggcgaagacttccaggtgctctccggcgacgacttcaccgccctgcccactatggccatcggcggctgcggcgtcatctcggtggtctccaacttcgtgccccaaaagatgtcagccatgtgcgaggcggtctttgccggcgacctcaagacggccaaggccctgcactacgacatgagcccgctgtaccgggcggcgtttattgaaaccaaccccgtgccggccaagacggccctggcgctcatgggacgcttccccttcgagacgcgcctgcccatggtgccgctgctgccggacaacaaggccaagctcgaagctgtgctccaaaaagccggcctcatctaagcgcccccagccacctctcgcgcgggccttccatccgggaggcccgcgtttttttcaacttccgcaacaggtttcgtgcaatccgccatgcgcatcgagctgcaaaacgcttccgtcaccctgtccggggccaaggccctgtccgacgtttccctgaccctggctgccggcgagaccctgctcgttcttggagccaacggctcgggcaaatcgacgctattgcgcctgcttcgcggcgacatctggcccgacgacgacggcaggggaagccggctctacgctgccgggcacggcccgggccgggcttcgcccattggcgtgcgccaccgcttcgccgtcatttccccggaactccagcgcacggtcaagcggctgtggggccacctggacgccaccaccgtcatcctgtccggcccccgcgacgccatgtacgtccaggccccgccgaccccggccgaacgggctgccctggaagaggcgctcacgcgccttggcatcgaccacctgcgcgacaccccggtcggcacactctccaacggccagctgcgggccgtgcttctggcccggggcctggcctgccggccgacggtgctctttctcgacgaatttctcgacggcctggacgcggccgccgcggtgaccgccagccaggccatggcagcggcggcggcctcgggcgcggccatcgtgctgaccagccataccggggccggcctgccgcccggtccggcccgggggctggtcctggccggcggccgcgtagtccatgaaggttcggccgagtcagcccgggaacaccatgcccgaaccatcgccggctgtctggaaacggttttgccggcccaaaatccggagtgcgccctggctgacggggccggcgctcacgaggcctcgggcctgcccctggtgattgtggaaaatgcctcggtctttctcgatcggcgagaaatcctgcgctcggtgaatctggccgttgccccaggcggccatctggccgtggtcggggccaacggctcgggcaagtccacgctcctcaaactcatggccggcgagcatcatccggccctgggcggccgggtcagtcggccggggctggccgcgcccgagggattgaccgacctgcgcgacatccgccgccgcatcgggctggcctcgtttgaactcgaagccgactacgacaaggaaatctccgccctggaggtggccctgtccggcagccaggccagcatcgggctctatgtggagcccacggacagggagctgcgggcggcgcagcggtggatggcctttttcggggtggccaagctcgccgggcgcaagctcggggcgctctccgccggccagacgcggcggctgtttctggcccgggccatggcggccgaaccgcgattgctgctgttggacgagccgttctcaggcctggacgcggcttcgcgccgggcggccatggaggccgtgtcggcggcggcccggtccggggtcacggtggtgtgcgccgtgcaccggcccgaggatgtgattcccgaaatacgggccgtggcccgcatcaaggacggccgggtcagcctcgctggacccggcgcggcgtttccttaggcgaagcggctttaccggccgcttgggacaccaccacgatctccccggccgccttggcgttgggcacgtagacggcctcgcccgtctcggagcggatggccacataccacgcccccatggactccacccggccgacgatgccggccaggctcacggcgtcgccccgacgaaacggccgcagcagccgcaaggtcaccccggcggccagattggccagcgctccctgaaagacgaagaccagcgccaaccccccagccgcgacggcgacaacgccccaggcaggccaccccttggcggccgccccagctgcagcctccggaccggccggagccggcgcgggagcggcattcgatgcggcaggcatgtcccgcggcccgcccacagccccggccggcgaaggagccgatggcgcggacggcttggccccgccggcctggggcagatcgcgcggaccggccgagggcggggacaagggcgcaattttttgtgggctgtcgggcaaatcgtgcccatgcaaggggggcgtggcctggggagccttttccgggcgcaactccaggccgccgctgccggccggagccgccacaggagcggactggacagccgacacggcctcgccagccgcttttgtgccgctcggaaggatgatttccttgcccaggggcagccgggccgggttgaggccgggattggccttcaagatggcggccgtgggcacgccgtagcgcagggatataagccccagggtgtcgccggccttgatgacgtatttgccggggccggcggccagcaccagggccggcgcggtggcatcccgggaatggcagaggttggcctgtccaccgagcaggcaggccgccaaaaaaaagatcaggccccagaatctcgccgcgtcgccggtcatgaacacctccgcaggccgccgtctggcggatggcatctggttagcacggctgcaaacaaaggccaagcgctgccttttgttacattttctctcctgagctaaacccgggtgcgccgggccgtgagcacgccggagccaatgggcacgatcacggcgtcaaatcggggatcggccagcacggcctcgaccacgcccgggatctcggcggcgtggctgatgacgttgtcggcggccacgatgccgccgggaaccagccgcgaggccagcagttccaggcacggagccaggacgtcacggttggcgtccacgaaagcgaacgcgacgccgtccaggccggccacgatttccagggcatccccttcggccaggcagaccagctcggaggagtccgtgatctccagggtctggcgggccagctccagcttatccgggtcgcggtcgatggacagcagcgtatccccccgctcgcggcaggccagggacagccacaacgcggaatagccggcgctggtcccgacttcgatcagcctgccggccggggccgaggcggccaggatggccaggtaacggccggtctcgggcggcacctggcgcagccgctgcccatggggcgtgccgtcggtgcggtcggcggcgtccatggcttccagttcggccatgcgggccagcatggccggcgtgagtccgtgaaacatcccttgccccccgttgcggccacggccgcgttattggaaaacaaactcgccgaaatagatgtttttcaccttgcccggaccggcgtacttggtgaacaggtccatgagctccttgcgcaggatcatcttgccggaattggtgagcagatcctcggccagcttgttggacagcataaggacgagatcctcccgggcatcggccttgtagaggcgctcggccgaaggatcgtcgacgcactccacgatcatctccaggcgcataaaccggtagccttttttgctcaggatattgacggtcatcggcccgatggtgatgacgccgttttccacttttccgggttctttcttctctttcttttcttcttttttctcttgtttcttggcttcgccgtcgccgtggccgccgcctgaagaggccgacagggcctggggcaaggccagaaaaagggccaggatcagggcaagtccaatcgcactgcgtcgcatgagcgctccatgaaacctggcccggccgtaggggacggccgggccgttgttattgcttttcccgccgagtttcgcgtccgccctaagcgcctatggcgtttggtcggcaacgaacccaaaccatgtactgttcttcataaataccagcgtagttatgaaggggcgcgacactagccccgggccttggcctggcggcggcgggcggtgaggatgggttcggtgtagccatttggctggttgatcccttcgaaaatcagctcccgggcggcctggaaggccagggagttctccaagtcggcggccatgggccggtaagccgggtccagggcgttttggcggtcgaccacggcggccatgcgcgccagcgtcgcctccacctcctcgggcgtgcacagaccatggcgcagccagttggccagatgctggctggagatgcgcagcgtggcccggtcttccatgaggcccacgtcgtcgaggtccgggaccttggagcagccgatgccctggtccacccagcgcgagacgtagccgaggatgctttggcaattggtctcgatctcccgcttcttgtcctcgggggaaggcgcttcaccagccggcaacaccggcaatttgagcagatcgaggcggttggccggcgtgcgcccggccagttcgcgctggcgggcgaagacgtccacggcgtggtagtgcatggcgtggagcgtagccgccgtgggcgaaggcacccaggcgcagttggctccggccttgggatggtcgatcttggccgccaccatctcggccatacggtccggtttggcccacatgcccttgccgatctgccccttgccggaaaagccgcagctaaggcccacgtccacgttgccgtcctcgtaggcggccatccaggcctgggagcgcatggcgttcttgccgaccaccggtccggcctccatgaccgtgtgaatctcgtcgccggtgcggtctaaaaagcccgtgttgatgaaaatgatgcggtccttggcggcgcgcacacattccttgagattgagcgacgtgcgccgctcctcgtccatgatcccgattttgagcgtgcgcggcggcatggaaagcgcccgctccacccgctcgaaaatttcacaggcaaaagcgacttcctcggggccgtgcatcttgggtttgacgatgtagacgctgccatggcgggaattgcgtttcctgcccaggtcacgctggtcgtgcagagccacggcggcggtggccagggcgtcgaggaagccttcgggaatctcctccccggccgcgtccagcacggcgtcggtggtcatgaggtgccccacgtttcgcacaagcatgaggctgcggccgggcagcacgagcttcccgccgtccggggcggtgaaggtcttgtcgtcggccatggcccgggccaaagtcttgccgcccttttcaaaggtcgcttccagctcgccccggaatagccccagcaggttgcggtaggcctgggccttgtccgggccgtccaccacggccacggaatcctcgcagtcaaggatggtggtcagggccgattccaggaccacgtccttgaggcccgaagggctggccgcgcccacgggatgggagcggtcgaaacgcagttcgatgtgcaggccgtttttgaccagcgccacggccgttggggccttggccgggccggcgtagccggcgaactggtcgaggcgggccagacccgtcatacggccgtcggcgaaggtgacggtcaggacgccgtcaaggacggcgtaggcggtcacgtcggcgtggcggccaaaggccagaggcacggccatgtccaaaaatgaggcggcgtaggcgacgacggccgcgccgcgcccgggattgtagcccggccccttggccgcgccgccggtctcgggaatgacgtccgtgccgtagagcgcgtcgtagaggctgccccagcgggcgttgacggcgttgacggcgtagcgggcgttggtgatgggcacgaccaactgcggcccggcgatagtggcgatctcgggatcaacgccggtggtttctatggcaaaatcagggccttcgggcagcaggtagccgatgccggtcaggaaacagtcgtaggcgtcgccgtcgtggggctggccgtggcgttccttgtgccagacgtcgatggcggcctgcatgacgtcgcgtttggccagcaaagcgcggtttttggggccaagctcggccaccagcccggccagggcggcaaaaaaggcctcggcggcgatgccggtggcgggcaggatttcccccgcgaaaacatcatatagggtcttttcgacggacaggccggcaacggccacgcgctcggtcatggggcactccttggtactgcctggcctccccgggaaccgggaggctggccggcagtgtacgagatttgccaaggagtgcaacgggaagcggcgcttcgctgcttcccgcaagcaacaaatcgttatttcaggacaatttcttccaaactcttgcgctttcgcggatagaccaccggctcgtcgggccgtcccacggccagcaggttgaccacccgccaaccggccggaagccccagcttcgccttgatgttggcctcgtcaaacatgccgatccaacacgtgccaagccccatctccgtcgcccgcagcatcataaacgacacggccagggccacgttcatggcgcaggcaccgaacttggccgcctcttccttggccgcctcgcgggccacgtaggcgtcgatgccgtccatgggttcgccgtcgatgatcttattgtcgcggtagaaaaaggcggccgactgggaatccttgacatagtgttcaaggtcggcgcagcaaacgatgatggccggcacctcggcgagccaggcctgcttgcggctggcctggctggtcccgaaccaggccaggttggccggatcggtgacgaccttaaagcgccagggctgagaattgaggctggagggggcattgcggccggcttccagcagttcgtggagctgctcgctggtcagcggttccttggcaaaagcgcgcacgctgtggcgcgccgcgatggcgtctttgacggacatggacatggggcgtcctcctgtgttttcccgttactacacgtctagctgggcaaccatgggatacgccggacggcgatagtctgtccgatttccgcttctttggcggcggcgtcaagcaggacttcaccccgccggccggtcaaagaccgccagatactcctgattgcccttggggcccttgaccttggacgggatcacgccgcgaagcgtcaacccgagctcgtcgcgggcaaagcccactaccgcctccaccgcttcctgctgaaaggcttcctcgcgcactacgccgcccttgccgatcttgtccggcgacacctcgaactgcggctttaccagcgccgccacgaaaccgcccggcttcaaaaaacgcagacaggacggcaagaccttggtcagcgagataaacgacacatcggccaccaccacgtccaccggctcggggagcagatcggccggggcatggcgcaggttgacgttctccatggacacgacgcgcgcgtcggcccgcagcttttcatggagctgggccgtgcccacgtccacggcgtagacccttgtcgcgccgtgctggagcagacagtcggtgaacccgcccgtggacgccccggcgtccagggccacaagcccggtgacgtccaggccgaaggcctccatggccgtttcgagcttgcccccgccccggctgacgtaacgttcgccctgcttgagcacaaacacggtctcggccccgaacatgcgcccgggcttgtccaccggcgtctcgcggccgcctggatcaatgaacagcacctggccggccataatgagccgcttggcccgctccgggtcgtccgccagcccctggtcgcagacaagctggtcggcccgggcctttattttcgccatgccgcgcctcccgaaaaatccaacggacgcgatccgcgtccgccagcgaccccaaaagacgcgttaatcgtccgcatcgcgacgccccaaaatccggcgcaaggtgtccttggaaatgcccagttcacggcaggcggcgttgcggttgccgccatggcgctccaccgcgtcgctggccgcctggaagcggatttcggccatggtgcgcccgcaccgggacggacaggccccggcctcgccgcgcagatgttccggcaggtgacacagttcgatggtctggccctggcagaggatcgccgcgtattcgatgatgttttccagttcccggatgttgcccggatagtcgtggcgcataagcctcgccatggcctcggggctgaccgtctcgatgttcttgctgacggccatgcggcaacggccaaggaggcgctcggtcaacagcggcacgtcgtccaatcggtcgcgcagggccgggatgcggatgaccaccacgcttaaccggtaaaacagatcctggcggaaggtcccctcggccaccatgcgtcccaggtcgcggttggtggcggccaccacccgcacgtcggccggcacggtctccacgccccccaggggctcgaaggcgcgttcctgcaaggcgcgcaaaatcttggcctgcatggcgtagggcagatcgccgatctcgtcgagaaacagcgtgccggcctctgccagggcgaaccggccgggcttgtccttgcgggcgtcggtgaacgccccggacttgtagccaaaaagctcggactccatgagctgctcgggcagggctccgcagttgacggccacgaacggcccgccatggcgctgggacagcttgtggatggcccgggcgaaaagctccttgcccgtgccggactcgccaaggagcaacacggtggagtcgctctgggcgatttgcggcaacatccgcacgatctccgacagttggggatcgcgcgtgccgaagtcgtccaagggttgcaagccggccaagcggctgacgaagccgccgcccgagagatcacgaaaaacctgcaccccgccgatgaccgtgccgcccatggcccagatgggcgcggcgctgatgctgaccggcacttccggacagcccgtgcgctttaaggtcacgatgcggttggcgatggcccgcgcctcgtccatgctctggcgcaacacgcagaccgtgcggcagttcctcacgccaaacacctcgcggcaggtgcggcctatggcttcttccggggcgcaacgcgccacctcggcggcggccaggttgcagtagcggacgatgaaatcacggtccacggcgaacacggcgtccgccacgttttccaaggcaaaagcgctggcttcgtcgccgggaaagggatcaaggggtcttttcatgggatgggggttctccgcgccggcgggccgagcgcggccggagtgtgcttcggaagccgtttggggtcaaccaaaacggacgcaaaaatcgtccaacagggtcaccaaaccccctggggaacttttaacaaactaaaaataaaaggaaaaatattcggcacgaaaagtgctttttttctcaaacaaacgggcaagcactgcatcacccgaaatactctcccaaggagtccccatatgaacctgaccctgaccatctccggcgcctgctgcgatctggcccttcatccggtgaacgccgaaaccgccgcccgcgtctgcatgctcggcgacaacctctacaagaccaactccatcgagtggtggcgcgccaacagtaacaacacctgcggcatgcgcctgaccgccgatgcgcgcatcgaagccgccctggacggcgcttccgtggcctttgacatctcccgcatgagcgcgtccgccgccttgctcacccagcggcccttcctggagagtccggaaaagagcctgtgcctgctcggttacgacgacgaggcctgctcgcgcacctggacctggcgcaacgtcaccgactacgacatgagccgcttcgaatttttcgtccagcgctgggacgccatcctcggcgtggccgactacctcgtcatcgacgacgtctgctacgacggccggccggccgatgaagccgtctggggcgaaagcgaaggcttcaccttccgcacgccgctcatcgtgcccgccagcgccgcccgagaactcgccgcggcgccgcgacgcgccgcgtagcggcgaagggagaacgcctccggcggccaggagaggcgctgcctctcctggacctctccgctgggggcctaaggcccccagacccccatcctggggaactgattaaggggtttcgacgtcagccgatggttagtgtggtccaggcgacatacgcgacagccatcgccaacgcatacgcaacgctcttcccgcgctggcgggcgggcaaccgccctcctcccgcccgccagcgccgccggtccctgccatgtcgccggccgccaataccgacgccggcctggagaaggtcccctctccaggccggcgttatgttgtgaatcgcgaaggaaagaggactccggcggccgggggcctgaggcccccggaccccccgcatggggaaagggggcggctgcgccgcagggcgacaaacggttcctgctcgttcttcctggaatcttcctgtttgggggcgcgtttttcgccaggttcctcctggcgaaaaacgcgccccctaactgggagggtccgggagggggtaaccccctcccggccgccggaggcatcttcttcttacgttctcatcatttacgcgccaggcccaagctttcgacaatggccgaggcggccttggcggtgtagtcttcgggagtgagcgccgccttgtcggcgtcggtcatgatggagcgcggccggttgacgtacttggggtcggccttgacgccgtaggcggcggggaagctgtcctcgaagtacatttcctggaagccgatgaatttgaggtggtgggcggtggcgtcgaggatggcttcttcggaggcttcgatgagcccaagctccttggccttttgcaggccggccaggcattcgccgccctgggtgcagctgatgtggccgtggcggttggccagaagcatgccttcgacgatggcctgctcggtgacctgcaccacctggaagctgccggggccgccgatcttttcgtattccttggcgaaatgggccacgcgcggaaacgaaaccgggttgccgatcatggccgcctgggcggcgctgggggtgacgggcacggccctaaactcgcgcttggccggatcggcctcatcataatactggaaaaccgggtcggcgtggtgggactgcacaccgaagatgcgcggcagggagcggatgatgccgagctttttgagctttaaaaagccgcccatgatggccgtgacgttgccggcgttgccgatgggcacgaacacgcatttgcggtaggtgtcccagccgtaccactgggccacttcgaaggcgtaggattcctggccgaggatgcgccaggcgtttttggaattgagcagcgccacgcggtagttgtcggccagatgctcgacgaccttcatgcaatcgtcaaagacgccgggcacttcgatgaccgtggccccgctgcccaggggctgggccaactgctggggggtcaccttgcccttgggcaggatgaccacggacttgatggggccgccgacataggcggcgtagagcgcggcggcggccgaggtgtcgccggtggaggcgcacacggtcagcaccgaatcccagccattgacccgcaccagatgtttcaaatagctgaacgcgcaggccatgccccggtccttgaaggaggcgctggggttttggccgtcgtttttataggcgaacggcacgccgaccagctcggccagggcggcgttggcggcaacgatgggcgtgtggccctcgcccaggtagacgatgtcctgttcctccatgaccggggccatgagttcgtagaaccgcagcacgccgcgcagggccgtggaacgcgacgaggcgcgcttgtcgaaaagcccctgccagtagctggccgggtattcgaggaggctgtcgaaggtggtgtcttcgagcaggaacacgccgccgcaatgggggcaggtgtagtagagttcgcggatgtcgaaccgggcctggcagcccaggcagacgtactccatcttgccccggtatttgggaaaatcgctcgtcgtgatcatggcgctccctgcgctttatccgcttccccttcggagcggaaggccgttaggacgtaatgcttcgcaaaaacgatcttgtggtcacctgcaacaatggccgaaccgggcggccagcctcaggccggccagagttcccgggcgctggccgtccacatgacgacgccgcaggccactttggccgtgaggccaaagaccttgccgtacagggctcccagggcggcgcgccgggcctcggcgtcgtcgcggccatgcagccgctcgaacatataacagccgaaaaacgccccggcaacggccccgaaaagagccccaaggcccaggaaaaacggcgcgccgcacagcgccccgccaaaggctcccagaaagccgcccaggttgcccttgccgctggctccgtagcgtttggccccgaaaagctgggcaaagagttccaccgcctcgccagccagggccacgcacacgagcagggcgtaaaacccaaatcccaggtgcaactccgggtggaacatgtcccacaggatgaccaggcccaaaagcgcccagtttcccggcaagccaaagacgtggagcgtcaggcagccgagcaggaccaggaggaaaacggccagggcgacaaggctcacgccccgctctcccgcttgtccaccacccgcgaggccttgccctcggtcttgggcaagctgttgcgctccaccagctccaccttgggcgtgaccagaatctcgtcgcgaagccgggcggcgatgcgtttttgcaaggccccgagctggcgcatgtcctcgacgaagaactcgtcgcgaatttccacccgcacccggatgttgtcgatgtagccgtcgcgctccagcacgatctggtagtcctggcccacctcgggcatggccatgagcacccgctcgatctgcatggggaagatgttgacgccctttatgatgagcatgtcatcgcagcggccgtgcaagcggtcgatacggcgatgggcccggccgcaggggcactgtccgggcaggaaacgggtcatgtcccgggtgcggtagcggatgacgggcatgccttcgcggccaagggtggtcatgaccagttcgccgagttcaccctcggccaccggctcgcccgtggccggatcgacgatctcggccaggtaggcgtcctcccagacatgcatcccgttttgctcctggcactcgaaggccacacccggcccgttcatttcggataggccgtaggagttgtaggccttgatgccgtagagttcctggaggcgaccccgggcttcttccgtatagggttcggccccgacgagcgcgatgcgcaggggcaggtcgcggggatcaaggccgatctcggcgaagatggaatgcagatacagggcataggacgggatgatgtggatgcccgtgaccttgaagtcggtgaggagcttgatctggcggtggctgttgccggccccggccggaatggtcaggcagccgagcttttccgcgccgtagtggatgccaagaccgccagtgaaaagcccgtagccggacatgttctggaaaacgtcggtgcgccgcaagcccaccatgtacatgcagcgggccatgagcgaggcccaccagtccaggtctttttgggtgtggtagatgacggtcggcgtgccggtggtgccggaggaggcgtgcatccgcaccatttcgctgtgcggcagggccaacatgccgtcggggtagctgtcgcgcaggtcctgcttggtggtaaacgggatgcggcccacgtcgtccagggagtggacggattcgggatcaaacccggcctcggcgaaacggcgggcgtagaacggcgatttggcggcctgggccagggaacggcgcagccggccgatctgcagttgggctatctcgggccgggaaagggcctcggcggcatcgtagcaatccacgacatctccttgctggcgaatgtggggagggaccccctttttgaaaaaagggggtctctccccacacccctcctcccctaaaaactttccacgggagggttaagtgacttgtgttgtgccttcgaggctataccctcggcagggcacgggttcaagggtcgcgggaggagaaaaagactcagcccatgccgaattcggacgggggcgggatgtcggagaggttctcgaacgccgtcgattccttgaggaacagcagcttcaccatgcccgtggggccgtttcgctgcttgccgatgatgacctcggccacgttgtcctcgggggtgagctcttcctttttcttataggcggcggcgcggtagagaaagatgatgacgtcggcgtcctgttcgatggccccggattcgcgcaggtcggacatcatggggcgtttgtcggcgcgctcctcgaccttgcggttgagctgggacagggccaccaccggcacgtgcagctccttggccagggccttgaggcttcgggagatgtcggaaatttcctgctcgcgggaatcgatgtggcgcgaggcgcgcatgagctggaggtagtccaccatgatgagcccaaggccgtgctcggccttgaggcggcggcagcgggcgcgcagatccatggtggtgatggccggagtgtcgtccacgaaaatgggcgaggcggacagatggttggccgcgtcgtagagccgcgaccagtcctcgtcgtcaaggcgcgcccggcgcagcttggccagatcgaccttgccccagcagcacagcatgcgctgcatgatctgctccatggacatttccagggaaaaaacggccgtgggaatggccgacatggcggcggcgcgcatggccacgttcatggcaaaggcggtcttgcccatggacgggcggccggccacgatgatgagatcggagggctggagaccggcggtcatctcgtcgaactggtagtagcccgaggccacgccggtgacgagttccttgttctccatgcgctgttcgatctgctcgaacacgttgtggatgatgtccttggaggacttgagtcccttggtggccttggagtcggtgatggaaaaaatggcctgctcggaggcgtcgagcaattgctcggtggtctgggccccttcgtagcagctgctgatgatgtccacggcggtgctgatgagccggcgctggacggatttttcgcggacgatctcggcgtggtgggcggcgttggcggccgagaccgtggccgaggccagctcggccagataggccgggccgccgacctcgtcgagcttgcccgaggcgcgcagggcttcggccagggacacgaggtccaccggggcgttgcgccgggccagatcgaggatggcctgatagatgaagcggtgggccggggagtagaaatcgtcctcgccgatgacatcgacgagattgaaaagcgtggcgtttttgaggagaatcccccccaaaaccgactgttcggcttcgaggttctgggggggaacttttcgcaggacgtcggaagagacccgctccagggcctgcccggtcagcggttcgccgcttcccgagccggcggctctggcgttacgcggtttcttccgtggagtgtccatcggcttcggcctgggcttcggccaccggagcggcttcggcgatttcctcgtcctcggggccgccctggcgcaccaccgagaccttcacggaaccgcgcagctcgggcaggagcttcacgggcacatcgtagtgtcccagcgaccggatgggttcggccaggacgatcttcttgcggtcgatgtcgaaaccgagttcggccagcttgtcggcgatgatggcggtggtgacggagccgtagagcttggcgccttcgcccacacgcacttcgatgacgatggcgatttcggccagacggtcggccaggcccttggcgtcggcgatcagggcgtcacgcttggcctggagcttcttgctctcgttttcgaaacggcgcagattggctggcgtggccagcatggccaggccctgggggatcagatagttgcggccgtagccgggcttgaccgagactttgtcgccaaggcggcccagattttccacgtccgcgcgcaaaatgagttccatggcttccctaccttacatcttcttcaggtgttcggcgctgtgcgtggccgtgtagtacaagagggccatctggcgggcgcgcttgatctcaagggtcaggcgacgctggcacttggcgcaggtgccggtgatgcgccgggcgatgatcttgccgcgatccgtgatgaaatccttcaggatgtccggacgcttgtaatcaacgggcaggtttttgttggcgcaaaaacggcagaacttctttttcggggtgaactttttcttaaaggccatggctaggctccctcaggcacgtatttgtcggcaagcttgacggtgatgaacttcatgacgccgtcggtgatgcgcacaatgcgttcgaattcggcgatggccgtggccggggcggcgaattcgaaacgggtgtagtggccgcgggtctttttctgcaccggataggccagatccttcatgccccactcgtcaacgctgagcatggtggttccctggcgttcgagaacacccttgaggttctcgacgatctcctgccgattgtccgtcgccagctccggggagagcagcaacaaggcttcgtacttccgcatggttcctccttttggtccatggcccttcctccgggacggttgtcctccgggaagagcaaggcgaaggggagtcgttagtcgtccgacccgcttttgtcaagccccaggcgcgaagacaacggccgcgacgccgacggccttggcctcgaaaacgccgccttgccaaggcgaccggccccgtctacataatcccacggcgcgtccgcgccaagcgccctttccgggcggccgaggtagccatgcgcatccgcgccaaactgctcatcatcctgctgaccttagtgctgccgccgctggtcgccgtcagctactacgccctgcgcgaggcccgacttctgggcgacgaactggcgacccgggccgcccagtccttcaagcacgccgccgaagccgaactggcgctcatggtggacctcatcggcgaggacgtgggcgacaaccggctgctgctcgaacttggccagaccatgctggccacggacgcggcccggattttggaatcgccagcccagccccccgaaccgggacttgcgccgtcgctgagcgccccgcccggcgtggacgaggcccagacccgatcatccggcgcgcccctgctccgcctggccccgacgtttgccaccctgcaagcccggcttggcgacaatctgctgtgggcctacgtcgccctgccgggcggcgtcatggccacggccccgagccatggccccatgccggccggctatgacgcccgcgcccgcccctggttccaggcggccatgcaggcggaccacctcgtctggaccatcctggtcgatgccgccacgggtcgcctgacggccacggtttccggtacggtgcgcggccgtgacggacagattctcggcgtagccggcgtcgatgcgcccctggaggcgctgttgccggaaagcgatctgtcgcgccgctggggcgacggggtgcgggcttccttcgtgcgcctggaggcgggccggctggagctcatcggcaaccgcgacttcctggacccggcgctgggctggaaaacgccgatgacgccgatgcccctggccatcgacaacgccgacggccaagccgccctggttgcggccatggagtcccatagaccggctttggtggccctgtccgtggacggcgaggactatttcgccgccctgcgccccttcaccgaggctccggccggactgcttgtgctggtgccacgccaagccgtgctgcatcaggccgattcggccgagtcggccatcctggaacgcacccaggccatgatggcggtggtggccggcatcacgctgcttggcgtcggcgcggcggtggtgctggcctttttcgggtccagggccgtgacccggccgctgaccgggctgaccgtggcggccggcaaactggccgagggcgacctcgacgcccgggctccggccggcgggcgcgacgaactggggcagctcgcggcgacgtttaacgccatggcccccaagctggccgaacggatgcggctcaagcaggacatgcttttagccaaggaagtgcagcaaaacctgctgcccaaggccccgccccatctgccgggcctggacatggccggggcgaccattttttgcgacgagaccggcggcgactatttcgattacctcgcctttgccgaagcgccccacggcggctgcgacgtcatcatcggcgacgccaccgggcatggcatcgcggcggcgttgttcatggccacgggccgggcgcttttgcgcggcgggcagggcgtcggctgcggcccggcggcgctattaaccctggccaacacgctgttgtggcaggacacggccgattccgggcgcttcatcacgctgtatttcctgcgtctggagggcggcggtctggccccgtacggccggctgacctgggccagggccggccacgatccggccatggtctacgatccggccactgacgacttcgtcgaactgctcggccctggcctgcccctgggcgtcctgccggaccacgtctacaccgagcaaagctgtccgggcctgaccccgggacaactgctgctcctgggcaccgacggcatctgggaggcgcgcaacaccggggacgccatgtacggcaaggaccggctgcgggaagtgatccgccgccatgccggcggcacggcggccgagctggtggcggccatccatgccgacgtagccgcttttcaggccggcgcgccccgggacgacgacatcaccgtggtcgccatcaaagcgctaccgatctagccccctcccccatgtcgggaggtccaggaggggctgagcccctcctggccgccggaggcctcttcatcttcctctttctctacaataagttacaaccaccgcgcccgcaccgcgttgcgaggcggcacggcggcgtagcgcagggccgggtagccgagcatgagtccgccttcgatgacgcagccttgggggatgcccagggccttggccagggcggcgtcgttgcgggcggcccgcacaagcagtccggcccagcaggttcccaggccccgggccacggcggccagctccatgaacgtcagcgcgatgccgcagtcggccgcgccgtagggagcgtcgtccggggcataggccacggccagagccggcgcgccgcgaagaaaggcgtcacggccatcggtccacatggccgaatacttgggccgcgtgccggcggcggcgaagtacgcggcggtcatggccgccagatcatggaccttggccgggtcggtggtgacgcaccagcccacttcctgggcgttggaggcggtgggggcaaagcgggccacgtcgaggagcgcttccatggtttcacgggccacgggcgtgtccttgtaggcccggatggaccggcggccgcgcaacatgccgtccacgatctcggggtcgggccagtggcgcagggtcttggtcatggccgccggatcgacccggctgatggtcagggcggatttggggcacacggccacgcaatggccgcaagcgatgcacagtttttcctcggcgaccacgggccggccgtcggcgtcggcctccaggcagccgctcgggcagacggcggcgcacaggccgtcggcgttgcaccgctccctatcgagggtcaaaaactccatggcgaacctccgggaaagcgcccgcttggtcagcgcagcgccaggatggagccagggtatgccccttgggcggttttgcaagcaggcacggaaaagttgcgtgataccctgcggggtaccgtatcggcaggctgtcggggcaacaacagcgtccctgccggtaacgatataacgggtttttttcttgaactattttgctcttcaacgtaagtcatctaaaggagtatcttggaggcttcatgcgtgctttggtagtggacgacgatccggccagccggcaggtgctggcggcccatctggggggggtggccgactgcgtaatgtgcgagtcgggcgcttcggccgtgtcggccgtggccgaggccattgtcgagggccagccctttgacgtggtcttccttgacatcatcatgccccacatggacggacacgaaacgttggtgcagattcgcgagaccgaggaaaccgcctgtctgccgcccgccgaccgggccaaggcggtcatggtcacctccatggacgacgaggccaacaccctaaacgccctgttcgacggccaggtcgcggcgtatctcatcaagccggccaaccgttcccagctcctggacaagctctcggtcctcggcttgctgccatcctagccgtcctcctcccgctgccctaacgggcatgcagcaccgaaacgcgcagcaatgcaaaacgcccggcaggaccacagtcccgccgggcgcgctagttttatcagccgtccctcgacggtcagcgcagatatttgaggaaggggctgtccggcgtcaaaaagagccggctgtttttggcgaaggccttgtggtaggcctccaggctgcgggtgaaaccgaaaaagtccggagacttgctcacggcctcggcccacacggcagcagcttcggcgtcgccctggccgcgcaacacctcggcctgacgttcggcttcggccaaaagcacggcccgctccttgtcggcgcccgacttgatcttctccatttcttcccagccctcggaccggtagagcttggcttgacgctcgcgctcggcctgcatccgcccgtagatggcctgagcgttttccggaggcaggtcggtgcgcttgatgcgcacgtccaccacttcgatgccgtagggcgacaacagccgcgaggacttggtggtcacctcgcccatgatgacgtcgcgcttggtggaaacgacgtcgagcagcgtatattggcccagggccacgcgcaactcggcgtagatgatgtcgtccaggcgggccgtggcccgggacagggtgcgcagggtccggtagaactgcaaggggtcggtgatgcgccagcgggcgtaattgtcgaccaccaggtttttcttgtccagggtcagcacttcggccgtcttggcgtcgtattccatgagccgggcgtcgaagtagaccacgttttgcacaaagggcagcttgaaatgcagccccggcttgatggggccgtccacgggcttgccgagctgcagcacaatggccgtctcggtctgatccaccacgtagagagattgggaaacggccacggccacgaaaaaggcgaccacgatcccgatgacaagcgacgttttcactgggcgcctcccttggccttggccggtcccgcggacgggctggccgtggtttcaggggccttgtgtccgggccttaccgcttccaggggcaaatagggcacggcctgccgggccgcctcgtcgctcatgatgagcttgtccagctcggggttggccaaaagcgtttccatgccttcgataaaaaggcgctgccgggtcacggccggggccttgtcgtattcggtgcgaagggccgtgaaacggtccgcgccgcccttggcccggcggatgacctgctcccgataggccccggcctcgttgatgatggccgccgaacggccccgggccttgggcaggatgtcgttggaataggcgtcggcctcgttgatgaaacggatcttgtcttcccgggcgctggccacgtccttgaaggcgtccaccacctgcttgggcggatgcacgtcctgaagctgcacggccaccacttccacgccgcagttgtacagctgaagcatggcctgaagcacgcgtttggtgtcgtcttgcaccgtgaccttgcccgaggtgagcacggtgtcgatcttggcgtcgccgatgacctcgcgcatggccgcctcggccgcgcttttgacggtttcgtccggccggtccaccttgaagaggtagtccacggggttgctgatctgatactggacgataaactgcacatcgacgatgttttcatccccggtgagcatgagcgattcctcgggaacggcccgggactgcgtggtcatgccgtcgcgggaggaggaacggaagcccacctccacccggcgcacctgggatactttcggggtctttacggtctcgatgggaaacggtaaatggtagtgcggccccggtccggtggaataggcgtaagcgccaaagcgctgcaccacgccggcctcgtcgggttccacgatgtagatgccgctggccgcccacaacagcgccaggacgccgatgatgattttggggccgccgggcagccgttttttcatatccgacaatctgtcggccaggtcctcgccaagccgtccagggtccggaatcggagatccctggcggcgtttttgctccgagagcttgtcccaatcccagttcatcctgaacgaataggggacaacaccggggcaggtcaagggacggccggacgcgaaacgtgcctcgccgcgcacaggagaccgcatgaaaccaatcacgcccgcgccgtttcgggcctatgacatcaggggaatcgtcgacgccgacttcgacgaggaatgggtggagcgccttggccgggcgcttggaacgtttttcctgcgccggggccacagccaggccgtggtcggccacgactgccgtctgacctcaccgggctaccaggcccagttggccgccggactggcctcctgcggcgtggatgtggtctgcctgggcatggtcccaagcccggtcttctactacgccgtcaaggccctaggccgccgggccggcgcggtggtgacggccagtcacaatccttcggaattcaacggattcaaggtctggtccggagaaaccaccatccacaccgacgacatccgggaaatctacgacatcatggccgccggggaattcccttcgggcacgggcatcgtgtgcgaacacgacatcaagccgtcgtacatcgagcacgtggccgagcagatggtgctgccccggaccgtctcggtggtggtggacggcggcaacggagccggcggcctcgtctgctgcgacgtgctgcgccaggccggagcccgggtcacgcccctttactgcgagcccgacggccgctttcccaaccatcatcccgatcccgtcatccacaagaacatcgccgacctggccgcccgggtcgtggccgagggcgcggacttcggcgtgggccttgacggcgacgccgaccgcatcggcgtggtggacaacaccggccggctgctctacggcgaccagctcctggccatctacgcccgggccgtgctccaaaaccatcccggagccacggtcatcggcgaggtcaagtgcagccacctgctctataaagacatcgccgcccacggcggcgatcccctcatggccgccaccggccattcgctcatcaaatccaaaatgcgcgaaaccggggccatcctggccggcgagatgagcggccacatgtttttcgccgaccgctactacggtttcgacgacgccatctacgccgccgcccggctggccgagatcgtggccgcctcgtccacgcccctgtccgagatgctggccgactggccggccacggtcaacacgccggaaatccgcgtcgattgccccgacgccatcaagttcgcggtggtggacaaggccaaacggcactttaccaatggttacgacgtcatcgacgtggacggcgtgcgcctgaccttcccggacggttggggactgcttcgcgcctccaacacccagccggccctggtggtgcgcttcgaagccgagaacgagacgcgcctggacgaaatccgccgtctcatcgaggaaccggtgacagcctggatcaaggagctttcctagggtcgcgacccgatcatgcccgtgtccgccggaaggccggccgcaacccggcccggccgtccggcgactccccgtcaacgccccggaggagacatgcgacacgccttcctgccccgcctgctggccgtttccatcgccctgtcgccgtgggcgattccggctttgaccctggcccaggactaccggccaaacaccgccctgggcgaactgctggcccacatgccctacgtcaaaagcgggaccaatcccggcggcaaaaacgtgttggaaaacagctgcatctacaaggacagcttctccatcagcccgtccaaggaggtgctggagcgctgcgacgtggccggagccgtggcggaattcacggccaaaaacggaccgcccgatttggtgtccgaggctcccggcggcaagaaactgctggaataccgcctgctgcacggcggcaacagctacttcgtcaagatctacgtggcctgcgccggaggcaagaccgaaatcttcgccatcgccgagtgcaaggaggaaaaaaaccgggtcaaacccggaccgcccaaggacgaccgctcgttttggaagaagatgctgccttgaatctggttggccgccaggccaaggcgcgatgccgccggcggttttcctgaatcaaacgcctattgactgcccgtcttttttatatatatccttgtatagctagtaacatcaaactacaaggagactgggcatggccgccaagaacgtgaagatcagcgccacaggcaaaaaccatcatgccgtcttggatgatggccctgcgttcgccatcgggaaagaggtcaaatacggggacaacatcggactgcagcacctcgggaacagcacgtcgaagcgctattcgccagaagagcatcgagaagaatatggattttgggccgacttcctggtccccacagcgacctgcgaaagcggcggctgttattcctgtctcaacacctacgacacggcgctgttcaccttcggttttttgcagtttgccgcccatgtccccaacggcgactgcatcctctatttccgccgtctgctcgccctgccccaggccgaatcctactttcccgacctcattgtaaaagagggccgcatccatcacaggcagggcggcataatgctcccccttgaaaccgatgacgacacgtcgggattccagcgctactttaatccggacccggccctgctgtcggacgaggaacgtcgacgagccgccttgtgcatccattggtgcgaaaacgatccggaagttcgcgaccttcaggtcgccgtcggcattgcgcttttcaaaaagaacatgaagctttacgcccaaaaatactcgctggatcaggccccggactccatctgcgccatcgtggccgacattcgccatcagggtcgcgccaaaagcgacgccatccttcaggccctcgacgccaagggccgctgggacgtcgcccggaccaacctcctgcgccttggcctggacaaataccccggccggccgcagcagttggaagcgaccctgaggcgtcttgaagacgaagggatttttggccgccgcgtctatgacttggcctcggccgacttccagctgctgtccgacgacgtccgatagcgccatgcgtcccgagcgggtccggtccgcccacggacctgcccgggacgcttccccgccatttgcccccaggcgcgattgcggctataaggcgatgaaatcagaccgccggacaccaccgcatgcgcatattcaaatggcttttcctgctcgccctccttaccgccgggggctacttcggctacaaacactacaccaaaaaacccgagccgccccgggtcatcgccacggccgaggctagcctgggcaacgtgcgcaaggtgttggaggctacgggcatcatcaaggcccaggtcggcgccatcgtcaagatcggcgcccgggccacaggcaccatcaaggaaatgcacgtcaaggtcggcgacgaggtcaagcgcgaccagctcatcgccgtcatcgactcccgggagctgcgctcccagctcgacgaggccgaggcccggctggcccgggccaatgccgagctgtcccaggtcgaaaccgtctacccccgccgcatcgccgaagccgaagccgaactgcgcctgtcccaggccaagtacgactacgccgcctccacgctcaagcgccaggatgagctgttccgcaaggaactcgtggcccgcgacgtcctggacgccgcccgccgcgacaatctggtcagccaaaacgaggtgctggcccgagaggcctccctggtgcgggtgcgcacggaattcgaaaaggaactcatcaaggcccagcgcgtccgggacgaggcccaggccgtcatcgactcggccaacaccaagatttcctatacccgcatcgtcagccccatcgacggcgtggtggccctggtcacctcccaggccggcgagaccgtggtggccggcctgcaagtggctaatctcatcaccgtccttgaccccagccgcctggaaatgtggatctacgtggacgagaccgacgtcggccaggtcaaggccgccatgccggtagaattccgggtggacgcctaccccggcacgaccttcaagggcagcgtcaaccagatctatccccagcccgagatccgcgacaacatcgtctactaccaggccctggtgcgcctggacccggccgaatcgtccaagctgcgcccggaaatgaccacccagtgccagatcgtggtgcaggagaaaaagggcgtgctggtcattcccaacgcggcgctcaagtggatcggcgacaagcaggtggtcttcgccgtgaccgagggtggcggcgtgcgcgaggtgcagcccaagctcggcctggaggggcttaacgaaaccgagatcgtcgaaggcttagccccgggcgaaaaggtggctacccagatcgtgctgccgggcctggccgcgccgaccataaacgcccccaaggccaaccgtccgggcggcggccgatgaccggccaggcgtcccccggcgaaggcgagccgcttatccgcctaaccgacgtcacccgcagctacgtcatgggcggcgtggccaacacggtgctctccggggtgaccctggacatcgcggccggcgaattcgcggccatcatgggcccgtcgggctctggcaagtccactctgctccacatcctgggcctgctcgaccgccccacttccggcagctaccggctgcgcggccaagagaccggcacgctgtccgacgacgccctgtcccatctgcgaaaccaagccattggcttcgtcttccagagcttttacctcatcccttacgccaccgccctggacaacgtgctgctcccggggctctacagcgacgccccgcgcgcggcccttgtccggcgggcgggagaactcctggacaaggtcgggctgtcggcccaggcccgacacaagccttcccagctctccggcggccagcagcagcgcgtggccctggccaggtcgcttataaacgacccggacctcatcctggccgacgaacccaccggccagctcgattccggcaccagccgcgaaatcatggaactcctcgccgccatcaaccgcgacgccggcaagacggtcatcgtcgtcacccacgacccggacaccgccgcctacgcccgtcgccagattctcgtgaccgatggccgtgtggcgcgttcttagccgctatccgcgcctgctatggcgtctgcagggcgtggccggccaagccctgctggcccacaaagcgcgcagcttctttgtcgttgccgccgtggccatgggcatcgcggcgctcaccgtcatcgtcgcctcggtggacggcgcgcggcgaaaggccctggaaatcgtcgatttctttggcccggacgcggtgctggtccttggcggcgacatcgagaaccggcccgttggccagcgcacaaataccctcacctggtctgacgcccgggccatcgcccgctccttgcccggggcctacgccgtgctgcccatgcgctcggtgcgggccgtgaccctgcgctacggcaacaagaaccacgaggcccccaccgtggtcggagccaccgagaattacgccgccacctggaactggcccctgtccgagggccgcgacctgtccgaggacgacatcgcccacggggccaaggtggcgctcatcggcgacgccccggccaaggctcttttcggcgacgcctcgccggtcgggcgcacggtcatggtgaaaaatctgcccgtgcagatcgtcgggcgactgtcctaccggggctttaccggcggcggctcggacgtgtccgtggatgaccgcctcatcatgcccatctccaccctgacccagcgtttcaacctggaccgcaactacttccggggccttcgcgtgcgcttccacgatccggacctcatcggggtccacatggaaaacctgcgcgccctgctgcgccacgaacacaagctcggccccaccgtccccgacgatttcaccatcatgtcggccagcgagatcctcaagttcctgacagcctttaccggtggactggtggcctttctcggggtcacggccggagtggccatcctggtcggcggtttcgtgctggccaacctcatgtttctgggcgtcagcgaacgacgcgtggagatcgggctgcgcaaggccgtgggggccacctccggggccatcctcatccagtttttgtccgaggccgtctacctgaccctggccggagccatcctcggcgtgggactcggggtgggcctgggcgagtccctgtcacgcctgggaatgctggaactgcgcctgtcgcccaaaatcttcgtcctgtccctggccgccgctctggccatcgccctggccttcggcctgcgcccggcccgcaaggcggctgacctcgaccccatcgaggccctgcgcggcggcggcgaatagccgccgccgcgcagccacgcctgcccgcctttcctgcccagccgcttgggtgccgcgtccacgacaaacgtaagcgctcaataaggcgcgtcttgttagggcgagcaggaagcaggataagctcaggcaggtatgatgaggctttgaggatcgctgtactggggcaggagggccttgcgttgggcgtcagtggttgccgccggcaagtgctcgaagaggtggcgcaggtagcggtatggctccagcccgttggccttggccgtttcgatgagggagtagatggtggccgaggcgtcggctccgcgcggatggcctgagaacagccagtttttgcggcccacggcaaaggggcggatggcgttttcggccaggttgttgtccggacgcagtcggccgtcttccaggtagacgaccaaccgctcccactgtttgatagcatagccaatggccttgccgagcagactcttgggcggggtggtggcggcgcgtgcatcgagcagcgccttaagcttgtccaggatcggcctggatttttcggctcgcaggaccttgatctgctccggattgagctgttgcctttcggcttggtgctccacgccgtagagtttgccgatcagatcgaggacggcatgggccgtgccgcctttggccttcttgccagcggacttctcgacctcgacgaacttgcgccggacatgggccaaacagccgagatggcgcaggccttcccgttcgcccagggcctcatagccgctgtagccgtcggtctgcagatagcctttgaaatcgccaagaatttccgcagccacgctgccggcccgggtcggatgatagcgaaacaggacgaccggttttcccggtgttccgccccgggcgacccacataaatgatttcgtggtgttggcccggcctggttcggcaagcacctggaccgtggtttcgtccatgttgacgatggggccggaacgaatttcagcgatgatcatgtcgatgagcggatcgcaggacttggctacgcggatcatccagccagccagggttccccgggagatgtccagccccaggcgagcgaactgatcctcctggcggtacaggggcagcgcgtcggcatacttggccacggcgacatgggccaaaaggccctgagtcacgatgccctgggggatgatttggggtggcatgggcgcggttttcaccgtcggcccatcgtcctccacaccttcgcaggtacggcaggcgtattttggccggatgtggcggatgacctggattttggccggcacgatgtcgagcttttcgctgacttcctcaccgatgcggaccagctcagcgccgcaggggcaggtcttctccgattccggcaggtcgtggatgatctccacccggggcagatccgcagggatggggcgacggccgcgtttgcggcgggtgctcgccggggcgcaggcctcctcgaaggtctgcggtttgtgctcctccgcagtctgctcggcctcgtcgaacagggagagctgctgctcctggccggtacggggctttttctcggacttcgggccgtaaatgatcaggttcaggagctgaaggcgctgctcaagttggacgatgtgctcttgctggtcagcctgactggcagccatgttgacaatgagagctttcagtgcggcagggtcgtcagggagggaattgatgtccacggcccgaacaatctctcattattattcaatttaatcaaggcaatactgtctaaaagagcgtcgaatactccagacgggagtgtcccgtcacggccaggggatcgagaccatcaagcagccaggccagttgccgggagtcaatggcaagcacctccgcctcgcgggttggccagcgaaacacatgccgctccagacgcttgtgccacagacaaaagccgttgcgatcccagtagagcagcttgatgatcgtccggctgcggttgcaaaagccgaaaaggtgaccggcaaacggatcgagttgcagctgccgtgaaaccaggatggacagcccgtcgatggacttgcgcatgtctgtggctcccagagccaaataaacccggacgccgcttaccggcgacatcatagccgtgtcagcgtgcggacaagcttttccagcaccggcgcggcgaagttgcctctgatctcgatgcgaaaggcgttgcccacgtgcactaggatcggtgccggcacggttgccatgtccgcctgggccgacgccggcagaggcacgggaacgagggtgacgcaggacgcgccctccttgccagtcgctgcctccaaacgcttccgccaatagcccatggaactttgggaaagaccctgccgccggcagtaagccccctggctcaggccgctacgatgccaagcctcaatatgttcagaccagtacgccgccttctcgaaactgagctctgctgatgacgctgccatggtcgccctcctgtgggataaaccatgacagaaaactcaagcggcgtaagaaggggttgattgaccggttaccgttagccagcagccacaagaaaaggcccctggtgcgacaacaccagaggcctttgaagaaggagccaattacaaaccgcttctaacgaccgcttccagttcttaggcctggaagcattttggcctgtaactagctgaattagcttggcgtccccaaggggatttgaacccctgttaccggcgtgaaaggaccatacccctacgcggattttgctgactttttcaataatcctaagcaattcgtaacgagctatgacgagatataccgagctatccgcacctcaatttacttctcggtttacttctccgaccaaaccccgaagcgcacatcaggctggcaaaaagaatgacttgtcaggcttcgaatggagcgctctcccccatcctctccccctatcctctctctgaccccaccctgctacccacccccaggcaatcttcgcgggagattcaggggcatgcactggctgagacgacagtttcgatattctcggtcgccatgcccccagcattccgggccgttgaaagctcctcattggaaaagacacgcccaatgtccaggatcaagacaaagcgttcgttgagcttgcccaagccaatgaggaaacgagtatcaacggctgaccccatccgaggaggcgggtcaatcctgtcctgttctaactccagaacctcctgcaccgaatccgccaggaggccgatgaggatacaatctccttcggttcgaacctcagcgatgatgatgcaggtatttgtggtgaataccgtccccgacattccgaacttgagacgcagatctatcaccgggatggccttttccctaacgttgatcacgccgcgtataaagtcaggcattctcggaatgcgggttatattggtattgtctaaaatttccttgacccagccgatatccagggcaaaaagctcgtcgccgagagtaaacgtcaggtattgatgcatggccataatttcagcgttgctcatgacgctatcctcccgtcggctagaaccgttcaaaatcatcgtcagcgtcgtgcatttctatagcgacgcccttggatttgactgccttcgacggggctgggcgcgccatacgtcctgcagggagcgcctttacgggcatgtgccttttcgtcgctccagagcctgccacctggaagaaagaaatactgccttggagttgctcagcttgtgcagaaagctcttctgaggtcgaggccatttcttccgaagcggaggcattttgctgcaccacctgatcaagctgctgaatggccttgttaatttggctggcaccagaattttgctcattgctggaggcggcaatttcttggaccaactctgccgtccgctggatatcaggcaccattttggtcagcatgttaccagctttttcggcgatctggacacttgaagacgacaagttgctgatttcggcggctgcggccccgcttcgctcggccaatttgcgaacctcggcggcaacgacggcgaagcccttaccgtgttctccggcgcgggcggcctcaatagcggcgttaagggccagcagattggtttggcgggcgatttcctcaatgatggatattttttcagcgatgttcttcatcgccaccacagcctgggttacggccactcctccttcttccgcatccatggcagccttgactgcgatggtctgtgtttgttgggcgttatcagcgttctgcttgatatttgaggacatctgctccatagacgaggaaatctcctcaacgctagctgcctgctcggtagccccctgggacatgctctgcgctgaagcagataattcttcgctgcctgaggcaacgttctcagttgcagactgaatttcggctacgacttcgcgcagacgatcgaccatgtcattaagggccgcagccaacactccgatttcatccttttggtcaatgtccaacttttgggtgaagtcccctcgggacatggcctgggcgaaaccaacacctttgagcaccggcccggtaatagcgcgggtcagcgccacagcaatgataacgccgagaagaagcgcgaaagccaagccaataatcatggtcgtggaggccgaagccaagcttgagacggtatcattggcgatactctgcgtctgccccatgccggccttggccgtttcctgggccgcttccagtacctgctcgccgacttcgtttcgttttgttccaagcgtttgcaacgttttccaagcggcaacgtactcagtcatagcggccttgtacttaccacctgcctcttttattgtggccagttgcctaagattattttcttggcgagtcaccgtctttaacttatcaagtagttcatcgatttttttaaaattattgagcgcatcgtctactaattgaatattccctgtagcctgtgccttaaaatttttgacgcgaacatcattccctaaatctatcacctcgttcgcctcttctattttactacgtcgctcttggagttttgcgacagaggctccttcattgatctccttttcgaatgcagcatcttggctttccataaaatcactacaacttttcaaatactcgcctgctgaggcgtccatcgtcttacgcaaagattccattgccttaatactgacagtcgtcgcttcaatcagttttccatactcgtccactttgccttgtgcctttgcgacgtcttcctttagctttgtcagcttggggaacttgtccgaatgcgccttggctttggccagttgggcgttgacgttggcaaactcttttttcgcagtttctagaaatttttcatcttcactgagtgcataaccacgcatagcatacatggtcatcatcgaatcacgttcaacgtcattcgccacagctacttctggcacgtattcttgcgccaatcgcgtggccccctgctccactttgctcatggccaccacagccaagccccctaagagacaagcgatgaggataagagctccgaagccgcccccgatcttaatgccaagcctgatattcttcatcagtccctccactggtggcaaaagtaaaaaaattattttaaacataccgtacttttcagctctttgacaatggggaacaacacctaggcggacatggctatcctcggatggtgacgggtatggcgtctacgtgaagtggtgggctgcggcagacctgccaggcacacctgccgttcctagattcctcttgcgcaacagcacggtaaatcgcaggcgccgtacggtgtgatggtaatccggctcaggtctcagaagcgcggcctgtcaagcagtcgttcgacagtcacctggacatcattgtagaaatgtgctttgttcctttaagtttgggaatccagtcctccaccacttgggtgatgattatcttggcttcgaatggatatatttataactatttaagggacataagcaattagtgactgtgcaaagatgcgagaaaaacgctcagagtagggaatagttagtccatcgtcttttcccagcctgcaggagggaatatgcacatccagacttcggaccagcccagccttgacctcggctttggcgagtacacctgcaactggggcgtccacctgtgcgggctctatgagaccgataaggaacgagacgcgataatcttcggctttctcgcgcagggggccaaggttggcgatctacaactctactgccctgccgaacgcagccgcgaagatttcgagtccaagatgagcgcggcctgcccgcattgcgggccgaagctcaaggaccaggaggtgttccgcatcagctcggccagggatctctactatccagatggcactttctccccctgggccatggaagacggcctgaacgccttctacgagcagagccgggaccagggcggcccgaacatccgcgccacggcggagatggtctgggccctggagaccatccctggcgtggagcatctaatggcctacgagtcccgcctaaactacttcatcaagggcaagccctgggtcagcatctgcctgtacaacgtggcgaaattcgacgggaagacaatcatgaaggtgctgcagacgcatccctacatcatcagccagggtgtcatctcggcaaaccccttcttcgtggacccggacatctggctgagcaagaacgctccagagttcatgaaccgtgacgagtaacctgaaagaccacgacctcttcctgctgctgatcaacctgtcgcaactcaacgacaggcatctggtggtgcgcatcttcacccaggcaatagaggccatgtggtcggagcttatcctgaagtggatcgaagggcctgaacaccctggcgagccctgtctgccggtgcggaccatgtccgggtactatggcagatttatcaccatgggctccgacgcccagttgtccgcgcaagaccgccagcttctgggtaactcggtgcagatgctcgcgctgttgctggagcgcttggcccagcgggaagagctggaaggccgcaaggcgcagcttgaagacgaggtaaagacccgcacaagagaactgaacgagaccctggagcgttaccaggccctgttcgcctcagtcagcgacccaatacttgtggccgacagaaacacgggcatcctggtggagtgcaacgaagccgcggaacgcttttttggtcgcagccgagagcagctcatcggacgaccgcaaagcgttttgcatccaccgcatactcgccttgtcaatggcgtgaccgaagactttaaacgtaaagcgactgacccaagaggtttagaggaaataaagctcttggcctctgatggcgaggtgcgtgacgcggaggtcactgctagagtgtttgatataggggagaacaagcttatcttgggggtgttcagagacatcaccgagcgcaaacgggcagaagatgcattgcgcgagagcgagcagcgataccgccgcatcgttgataccgcccaggaaggcatccgcatcagcgacgaatgtggccgcattgtctatctgaaccagcgtatgtcagacctcctcggatactcacaggatcaaatgctaggcagaaacattgaggattttcttttccctgaggacctggaggatcaccgccaaaggatggaagaccgtcgcaggggcagtgacgcttgctatgagaagagattgcggcggagcgacgggaccgctgtgtggactctcgtctcggtcaagtccctgcctgatgcgactggccggtatgacggctcgttggccatgttcagcgacattaccgaccgcaagttggctgaagaagcactacaccaggaggacgcccgtttgcgcaagttgctggagattatccagtacgacacggcaaacacccagtccttgctggatttcgccctgggcaaatgccttgaactgacgggcagcaggttcgggtacatttaccactacgacgaagattcacaatcttttacgctcaattcatggtcacgcgacgtcatgcaggcttgttccattgcaaatccacaatcttgttacgaactctctaaaacagggctctggggcgaggctgtacgccagtgccgtgcagtcatcgtgaacgacttcctgacggacaaccctctgaaaaagggctatcctgaaggccacgcccaactgacgaacttccttacggttccgattttaagcaataaacgcatagtcgctgtcgtgggggtggccaacaagcaaacagactacatggatagcgatgtaattcaactttcactgctcatggatgcgacatggcgggtagtggaacgccgacaggcagaagaatccttgcgtaaaagcgatgaacgcctgtccttggctctaatggctgcaaacgacggcatgtgggactgggatatctcttcaggcaccacctatttcagtcctcgctactatacaatgcttggctaccagcctggcgaattccccagtgactttgacacgtggaagagccttttgcatccagatgatgtagagcatgccatccacattgtctccgaaagccttaataattctgaagggtttgagatcgacttccgcatgcgaactaagtcgggggattggtcatggattctcggacgaggccgggtggttgaaacggacgccgagggccacgcaaaaaggatggtgggcacccatgtggacatcaacgaacgcaaacgctcgcaagccgatttgttgagtgccaagctgcaggccgaagctgcaaacaaagccaagtcagagtttttggccaacatgagccatgaaatacgcacccctctcaacggaatcctcggcatgcttcaattgcttcagactactgaacctaatgaggaacaaaatgagtaccttactggagcaactcggtccactaagcgactgactcgacttctctctgatattcttgacatctcaagaatcgaagcgggcaggatggatgttgttgagactgaatttgacatctatcaactgcaggattctatacgcgaaattttttacacggaagctcaggggaaaggcctcgttttagatttcatttgggacgatgaattgcccacagttttgattggagacgaagctcggcttcgacaaatccttttcaaccttgtcggaaacgccataaaatttaccgacaaaggagaagtcctggtcgaggtctctttgttgccgaattcaaacttttcttctgtacgcgtgctgtttactgtaagtgacacgggaataggtatttgtgaagaacatctcaaatatatttttgagccatttgtgcaggctgaaatctcgtacacaaaacgctttcagggcgctggcttggggctatccattgttcggcgattggtaagtatcttgggcggtgatatatcaattgacagtgcccttggcgagggaacaaccgtctacctctcgctgccgctcaagatttttgcacctaagcagaaaccactggagcttgtcacacatgaaacctcacctcctagacgagttcccaggcgcatactcctcgctgaggacgatccgttaagctcacttacctgcaagaggatgcttgagaaatccggctactcagtcactgccgccaacgatgggcaggaagcgctgcagcgactgaccgaaaatgacttcgacttaatccttatggatgtgcagatgcctgtcatgaacggcatcgaagctacaaaggcaatcaggggggcaaacaatcttggagcgaagtcgagcatacccattgtagccatgacagcctacgcaatgactggagacaaagaatcatttttggcagcgggcatgaacggctatattgcaaaaccagtagacaaaggagcactgtttgaagctatagaaagagttctacacacaaaatagtgctacaatgatacatctgcaaaaaagactctaagtgatggcggggatcggggtgtggcttcgtctacccagatgagtgctggcgcggaatatataacttcctactgaaatccccttcatgactgtgaatccagttgccgtgcgattggaggtaaagcgatgggactggccatcatcagggggagctatcacgagtctcagccgagttttggaaatctgattgccgcgcttaaagaaaacgcttacaggtacaaggctgtaccgcattgatcttcatgcgatatcccaatggcaggaggctgtccgatgccgaccccaagcaccaatgccccctcccgcagtcggccctcatctgactccagcctccttaataatctcaaaaaatcaagcatattcaatcatttctgtccggctaagaaaaggcttgacgcctgaaagcgacaactgaactagattcatgatgcctgtctatttcggcgatacattttggaaaaacgtcaccgaccaccatgaagtcaagttcaaaaatccttgcagaacgccaccaggcagcatcagcacgcgtcacagagcctattctagaacagaaggcacttcttagctttctttataactatgcggaatcactcttgttgctgtatggtgtagttctgaagctcacctgcaaaccgacaagaggattccgcacatgcaaagcgctatcaccgtcttcgcccaatttctatcccttgtgccgaaatccgtatttttcaagctatctcagaattataggcctgaacgctcgcctcggacattctctccgtggagtcatttcgtccacttgctgcacgcccagttggccggatgcaaaagcctgcgggacggaatcatgggcatgaatgccgcttccaaccggctctaccatcttggcgtgaagcctgtgccccgttccacctttgccgacgccaatgccaagcgcccatacaccatgttcgaagccctgttcggcgaactctacacgaggtgtctttcccaagcgccaaaaaagaaattttcttttgagaacaagctgttcagcctggacgcgtcggtcgtcgacctgtgcctaaacctgttcccctgggccaagttccgaacggccaagggcggcatcaagatgcacacggtcatggaccatgacggctatctcccggctgtggtcaccgtcaccgaagccaaatgccatgaggtcaacatcgccaagctgctcaaactgcccaaaggatcaatcgtggtctttgaccggggctacaacgactacacgtggttccgacacctctgtaaatccggcgtcttcctcgtcacacgactcaagagcaatgcacggtttcgggtcatcgagcgccaccgcacggatcaggcaacgggcgtcacctccgatcacatcatccaggtcgcagtgggtgaaaaaaccatgaccttgcgccgcgtcggctatcgtgatcaggaaaccgggaaccgtcttgatttcctgaccaatcacatgaccttgccagcaagaaccattgccgacatctacaaggaacgctggcaggtcgaaatcttcttccgcttcatcaagcagaacctcaagatcaagtcgttcctcggcaactcgaaaaacgccgtcctctcccaggtctacgtggccctgatcgcgtacctgctcctggcctaccagaagttcatgtcaaagatcggcctgagcctgcattacctggccaggctggtgcaacgaaattgcaacatcctcgacctcgttgaaccccagcgaaaaagtgtaaaatcaaatgatcctgggcagctatcgcttctagcttagccggacagaaatgatattcaatccaacaaactggagtctcaggcttcgatttttgactgtccccgctgctcttcttggactcggctgcttgactctggcctttatcttccagcgataccaggatatggtggtcgttgaatccgtcgacagtcgcctgtccgtgttccaacactggattcaagacaagatcacaaacgaattcgacgtactcttgtccgaagtctcgccgctcgctgccatgccggaagtgatcgagagagcatgcgccaacgcgacaaggaccaccttgtccgctacatactaccctataccgaacgcctgcgcgccaccaccggacgcgaatcactctatttccattttcatctgccgccggcggtctcgtttctgcgcacctgggacgtggacgccaccggagccgacctgacggacatacggcccatcgtggtcaaagccaacaagtaccgatcaccatttcggggcatcgaagtcggacccggcggcgcggccatgcgggccatcatccccttaaacgacgggtcaggcgagcacatcggcacagtagaagcggccacctcccttgaaaacctgctggagacgacggcccagccttatttcagagcgatgcttctgctcgacaaacgctttgaatccgtgctcggccaaaaccgcatccggggcgttcacggcaaatggatcgtcgggcgcggtttcagccttccccaggaaaacctagtccttgaagcactggacaattcaggagtacccgaacgactaggcaacgccttttatcgattcctgcccctggaggacttcgaaggccgtgccatcggaggcatcctgctcggctacgactccatggcgttgttcaaatcaacggtcagcgagtccctggtctttggccttatcttcctgctcggggccatggtgctgtggtttcacatttattggaacgtggcccgggtgaagctgtttctcacgcatcttgaacgcgttcttggcaacaccgtctccggagactttagcggacgcttagacaccacgccggtccattgcctagacatcctgcactgcaccaaaacagactgtccggtctatcacgaccccatgcgtatctgttatctggaaacagggtccgaggctctttcggccgtcagccgcaacacctgtatctttttaagccgctataagcactgccggctctgtccagtctatgcccgacggcgcggtgatgaactggtagagatgcggcacactgtcaacaccctcgtgcgtctctggggcgggtttatgggccgggtggaccaggtggtctctggggtgctgcagacttcggaagcctcgcaaggtccgtcgtcactgggccaagtgagcgcttccctagaatacatggccggcctgaccgcttttagccacgacatccagggcgtttataaccgatgggaggtttacaatattttaggcgatgcctgccaacgcagcctgggactggggcagttcgccatcctggagttcgccgccgacgggcttgcgaccaacgtcgctgccaactgcttcgccgccaccgacgcgctatgttcggagatgttcgccagccctgaactgtgccgggccaagcgcctgggcaaaccagtcttttccgaaccgaccccggccctatgcccctttttccatgtcgatccaactacccatgtccgatgctgtctgcccatggtcatgggcggcgctgtgggcggcgtaatgacctttgtgaccgaggccgcagcctttgcgagcaaacggttggcattgtccatcgtgcagaaatacctgacagaatgtgccccggttctgacttcgctcaatctgttggaaataacccgggaacaatccctgcgcgatccgctgaccggcctgcacaatcgccgttttctcgacagctacgtgcatcagtacgaagaaatctcacggcgcacggaaaaacgcgtcgggtttctcatggttgatgtggattatttcaagcaggtcaatgataaatacggacatctggctggagacgcggtccttaaggaactctccgcccttgacagttgtcgttgtttccagcccgtcgaaatcgacctcatgccgtctacccttagtggtccggaaattgcatgcatacgacatcttgatcccagcacacgccacgagtagacgacacttcggcagtcgccgctgttccgcatcgaagttctaaatagcccaacaccatgctcatcaatctaattgcgctatcatatcccatgcaaatagcaaaaaaaacaattgaaaccggcaaacaaaatagaactaagacatacttcttcggacgttttgattgctttgcaatgtttccgatgtggacctgcttttaatctgcgaaatgaccagttgcccgtcacgctgctccagaggcgggattgtaccacgaggcttatgaacattgctccgcctcggtcgcttgatcaacagaaagagacatgggcaggcgcactgtaactgttgttccggcagcctcggacgtctccatagcgatgttcccacccatagcgcgaaccatcatagcggcgctatatgtccccagtcctgtgccaccaaccttgccggcagtggcgtatttctcgaaaaatcggtcccggagttcaggcggcacggccgcggcatttgagatggtgacggacaatacgctgccaccctcaatcgagatatccaaaccgaccgtatcatccggccccgaagcctcaacggcgttgcgtaagagatttagcagcactatgtcgagcaaaagcggatcagttcgaaacccagcgagagactgcccgctcaggatggtatgatctcgaatggagaatcgttcaggggcgaggtccatgctcaagccaataatctcaatagcgttgccaatcagcaagataggatcgcaagcctgtggcttgatttgataggtgcccgactcaattttatgcatttctagggaactgttaatctgggttagcatcctacggccggcagccgccatcaggctaagaagccgccgctgatccggtgtcagattgtcttcttccatgaggatgaacggaattgtaatggcggcgttgaggggagactttagatcatgccgcacgatgcgttcgacatcttccttgatcctctccaggcggcgcatctcggagatgtcgtggatggtggagatgaccagtttgtttccgcgaattctgatttcacccgcgtagacctcgacgtccctaatatcgccgtcagcccgccgatggcgaaaaaagaaatgtatttgttctcctgacggcacctttgctagttcggccagtacttcatccttgggcagcacgttcaaatcataaatccgcattgcggtgagctgctcacggttgtacccgtagaaaacttctgccgccgggttggccgcgaatatagtgccgtcagtcggatcgatgatgagcttgatggcgtccaaggcggtgaagaaagcccggtagcgctcctcactttcctgtacggcctcctcgaaggccttgcgttcagttatgtcttgatgggagccaaacatggtcagcggatttccctgggaatccttggagaaaacccggccccggtcatgcacccagacccagctaccatccttgcgcctcattcggcactcgcaatcgtagtagggtgactcgcctgaaaaatgtttgcgaagcttctcgccggagcgtttcaagtcgtcagggtgggccagagacgcccaggtgtcgatgctgaccggagccaattcctccagggtatatcccacaatttcggcccatcgcttgttgaagacggtctcaccggtttggatgttccactcccaggttcccaggttggtgccctccaggacgtaggccagacgcatgcgttcatttcgcaaggcttcttcggccgttttgagctttgtgatatcggtggagaagccttcgtagcgaatgatgacgttgttattgtctctgaccgcccgcatggacagggctacccatatgaacgccccatccttgcggcggcgtcggacctccatgcggtcgatattcccgtactcaagagtcttgtggatgttttctcgctctccgggatccacatagagctgtgccccgatgtccgtgatgctctctatgaggtcttgggcggaatcatacccatacattgtcgccagccgctggttagtggcaatgaagcggccgcctggagtggactggaagacgccgattggcgcgttttctatgagttctcggtagcgtttttccaagttgcggataacttcttcggcctgcctacgggcggtgatatccctggccgaggcgtacagaagaaagcgaccgtccagttccatgcccctggcggtgatctccacctcaaggagcgttccgtccttgcgcctgtacttggtttcgaaggttcggcccgaacggacgagggcgcggatggtggggaccagttcctctttaggaaacccggcgtcccagtcggcaacgcaaaggccagcagcctcctcagcggagtaacccaacatcgccgcgaacgaagggctgaagaagatcaggcggccgtcttcgtccaatatgtggatgccgtcggttgcgttctccaacagggccgcgaagcgggaggactcggccctgagacgggtttctgctatgtctcgggccttgtggttctcgaccagggcctggaccatggcgttaaagtcgtgtctcagcgtctgaagctcacgacatcccggcacgctctggatgggaagcgggtctctccccccggcgacttcagagacggcccgcgatagcctcacaacacccgaaatcacgatcagatcggacaagaagccgttgatgaccagggcgacagtggtaacccccaggatagcgagcaggatacggccgaagatcggccaggatcggctgccccaatcaggcgtagggatccctacaagaacacctagatagccctgacggtcgccctggggccagagtttgacaaaggcgtaagttagcgctgtacctgtttgatccttggaagtgaaggttccggattcactattgttggccgcaatcacgtcccatacggctattttggggccgactgatgaaatgtctcgttgaggatagcgcaacagcctagttccctgatcgttaaagagaacgagccgacctccttcagggatggtcaggctgctataatacttatccaattctgttaacttgagccccaggagcagaacacctgacatccggcccccggcatccttgaccggcaaaccgaagggcagcaccggcaggccggtggtgcgactgacgatgggttgccccacgttgaaccgatcctcgcgaagagcgacttggaattgctcgagatcgttcaaatcgattgaggtgtcggaggaggaggatgacgcccacaggtgtccgtccggaccggccagagtcagataggcatattgagagttggcggcaataatccgctggaacaatttatggacgttgtccggctcctggaaagcgaggcttggggtcgcggccagggtctccaaaagtgtccgggcgtgacggaggtcattgtcgtatttaagggcgaaaagccgggctagccccattgaccggtcgaagacctcttgccttccagcctgaagctgttcctggcccaagtagaccgtcagaaccaggaggggagccgtcacgcacagagcagccgctgacatgagaaaacgcaaagaacgtcccgcaataaaggccttcaactttcgcacaaatgctcctccccccttttattaggaggacgtgagaggatgcactcatctgatactgcgcctgcctgccacctacagtatctacacacgcattcctatataaaacgagaatttgtgactacaagaggacttggcccttctcctgaacgttgccgacagcttcaagttcgacccaacgaacaattagtacgcacatttaagtggacaaagctatctctgttccaacccgagtgactaaggctcctgccaacacagtaatcatcttctaaccaaccaaaatattatacaaatagctccgtcgccatggcgcaattgtcgtcacccaacaggtggagctgtccatgtcccggtccaaattcaaaagttcccgtcgcatcgatgccgttgaagtcacatccgattgcctgactgggcgagctaattggttagttatatgttacgcctgccccaaacaaaacagctccctgcaaacagcatcctttgactcacatacaaacataaaaatgttgctccatccctcgcactcgcgatagacttccaaaaaaaatcgtaggaatgtataaatatggcctttgcagaacttaaatcgatcaattcaggcctaataaatatgcaaacagtctctaaagtatttcagctttaccatccatcagaacactacggattcactctggagggcgtgagttggcacggacagtctcgatcaatttggacggtagatagtttgcagtgtttccacgacactgattaatgcgtcaacaacaatcgaatcaaaagcagtaccccggccgtctgttataatcgctaacgcttcggcatgtgataaggcgtttcgatagacacgtttattgaccatggcatcatatacgtcagcaacagatacaatacgggcgcttagtggaattgtcgcacaatggataccgtgcggatagcctgttccgtccggccgttcatgatgtcccaaggcaatttcccttgccattgtcaaaagcggcgtggaagaatttctgagcatttctccaccaatctgtgcgtgctctttcataatagtatattcttcgcctgtcagccgtcctggtttgagcaagacggcgtcagggatgccgatcttaccgatgtcgtgaagcggagcagcttttcgcaatagagccgcgccatcctcgttccagcctaaagattgagcaagcaaggcgctgacacggcctacacgttccacatgcatgcttgtttcgagattacgaaagttgagcgccgccagcaggtttcggctaaagtcctcatctgtacatcgggagtgggcagcataattgacagcctcctggattgccgctgctaaccggtcagcgcgacagggcttcataaggaatttatagacatggccttgattgactacgtcagccagcctctccatatccgcatggccggtcagcgcgatgcgagtcgacaatggtgcgagcattttagcgttgctaagaaattccacaccgtccataaccggcatcattatgtccgaaacaataacatcgaatcgtaggcccatcctcaataggcccaaggcttccatggaactctgggcgattgttacctcaaattgtttacgaaaaattgactgaaacgtctctaataccgatagttcgtcatcgacaaacaagattctcggcaagcaaggtgttgttttctttttcacaataaacctgaaccgtggctgtcgtccaaagggataagcacgcagatcggctcatgaatgctaaagctcttggatacttcttgcaagcgcaggatgctagcatcgtttagttcagtgccacttgacaataaaatgatgttgccaaccgccgttacatgctgggcgaggaccataccttttttaaagtgtcgcactgtaatacatcttctgacatactcgtcgctcgtgcaagcagctttctccatggcgtcaagaatatctggatcgtaggctcctttacgctcacgaaggacgaaaagtatctcgtttggagcgctgcccctactttccagagcgtcataatcaagggccagccgaagcacacgcgccccctgaggaattgtatgagaataatcatcttgctgtgcggcgataatctcagcaacaccgcctagtcttggaatatgttgaataagcatagctcccagcctggggtgctctctataaaggaaagattcttgagcagtgagtttttttccggtttcaactttttccagtatttgctggggcaagcccatgcaacctatatgggatagcattgcggctaattcaagttccaacgtggatttcatagtcatgaccttggacaatctgcccacgagtgccttgatcctttgcgatttgccgaaagccataggattagccaaacccaacgcctcagtaagcagcttaatcgttccacgaagggtgccgtgcagaagttcacgctccgccgtgataagctggtactgccgaacccctgcttctagggcggcgagaaggtctggcatcggacagggtttggtgagaaaacgaaacacttgcccctggttgacagccttaatggaggcatccataccggcatgtccggtaagcataatgcgcgtcgtattcggcgaaatctcccgggcacgggaaaggaaagccacaccatccatgcctggcattttgagatcggacaccacggttgcaaatggcccctcggtttcgagggcctgcaggcctgcttctgggccttgtgacgtggtcacggcaaagtacttgcgcaggttgttccggaacgcgtccaaaatatggcgttcatcgtccacaaaaagcactttatccatcactgcagcctcctgtatccaagaccttggaacaacagcagcgccacagagccaatcgctcctggctacgaatcgtttcgacacccgggaaacaaagaggccaatgggtatgttccttacttaaaagcaccagttcgtgatctagcccgtcagcaacataaacggctgaccctgagcaacacggctcaactatctgcttttcaggcgtgtggtgccaacagatagcccccataaccccatagctaaacccccaaagacctaacagataagcaccaacttgggcatggcttgcattaaatacattctgttccgcaacatgaacggacacagcgtcggcctgaaccttagcgaggacatctcggtattgactaggcatattcgccgcaaggatgagtttgccaacgtcgtgcagcataccggcgataaatgcattgtcctgctcgtcacgacacaggccttccgcttcggctatcagcttagcaaaacagccgacccgcaggctgtgctcccagagctttttaacggaaaaggatggcatggaagctgcttcaagtactgtgaacagatgacttgagagcaccagcacgcgcaacgtctgtccgccaatgaggttgaccgcatgctggacgcttgagattcgtgtcggcaagccgaagaaggccgagttgaccagacgcaggatggaagctgacatggccacgtccttggcgacaatgtcgcccaactgcttaagtgtggaatgctcctcctccaacgcggacaccagttgcctgtagacatcaggcaggctgggcaaggcgtccaagctggagacaagtgttttgatctgttgattttcgagcacatcacgtagacttaaagctttttccactgcctcaatcaagtctacaggccggcatggcttgctgaggtactgatgagccaacttgacggtctttagcacactttcctcttcgctatatccagaaagaataatgcgcacgctcttcggatagcgcaactgcacctcccgcagtagctgcgccccgtccatcccaggcatgcgcatatcgctgacgatcacgtcatggggttgttgctctagcagttcaagagcaacccttgctcccagggcgaaggacacctcccacttagcgcgcatgcaacgcaagctcaagcgcagactgtccaggatgttttgctcatcatctacaaaaaggatttttggtttcatggctgttacccgcgagattatccggcaagaggcaggcgtataatgaatgtggtcccctggcccggctcagattcgaatgtgatggaaccattgtgcttgttcacaacaatgtcgtaggcgattgccaacccctgccctgtacctttgcctacttccttggtggtgaagaacagattaaaaaccttatcccccacttcctttggaatgccagttccagtgtcctggatacgaatttcggcgaactcattgtcctttctagtgctgatggcgatgcgcccaagaccgttgctctcgcgaacgacatcgctgattgcgtgagccgcattgacgataatgttgagtaagacctgattcatatcaccgaccaagcacatgacggtcgacaattcgggatcgaagtcggtagtggcctcggcaacgtacttccattcattccgtgagatcacaagtgtgttctcgatggcgtttcgaatgtccatagcttttttttcattgcctgaattataggaaaagcgcttcatggccaacacaatggtgctgatgcgttcaataccctcgtagatgcgttcgatggtcttggggatttcctccccgagaaaaggtgcgtcgatctcttccagcagggaggagagggatgccgctattgcttggccacagggtgagggcaggcggctcaactcattggcttgcgtcaccaaacggttcaaatcttcgtaggcgtccttgaggaacgtcaccgaatcgccgacgtactgagtaggtgtgttaatttcgtgggcgatgccggcggccaactggcctatggcctccaattttgctgcttgggagagctgggcctccagagcgcgaacttcggtgatatcctcgccaagaagaagataacccgacatgtcggattctttggcacaaagacgagtcacactgaccaccagaaatccatcagaaccatctggtcgttcataccagacgttagagagcttcacggtctgaccggtctcgcgacaagtcgccaaaccgttggccacttcattccagtcccaggctaagggtagctgggcgaaccgtcggccgaccacctcgccaagcgacatgccaaaggacagatgtgcagcattgccccagtgcgtaacctgcccgtcggcgtccaagacgatgagaatggccgaaatggagtccaggatcagcttgattgcctgatgggccttaaggcgttctgcgatctcttcctgaagaagagcgttcgccaaggctagttcctcagttctgagtctgatgcccgcctccatgcggtcattggcttggcgaagttcttcctcaatgtgttttttttccgtgatgtcaaaaccaaggccgatgagtccgcccaggccgccgtccgaatggcgcagggccagcttgcgggtaataagccgcacctcccggccatggtccagaatggtttcctcgacttcgtagaaatccttgtcacccgaaagtagaagctggtcatcccgcatatagccctgggctaggtgttccgggaacaattcatcatcgcgtttgccaactattgcctccaggggaaaccccactgcggcgcaaaaagaggagttggccgtcacgtaaacgcctgcagagtccttgtaaaaagcgtagcctggcaacgcattgaataaagtggagaattcatccatgcgcttgcgcaaggcgctttccgagcttttctgttcctcgacccgagcattgagaaccattctttgagcatttgtccggccaaagagggcaagaccggcaagcagaacgaggctgagagttccgatcaatactaacaatggccaagtggcagtgccgactaaggccttttcaggtatcatgctgagtaccgtgaacggtgtgccaccgacccgcgccgccgttcccagcagtgggccggccccgatcccatcctttgcgcctggaacctgagaactggagatttggctcaccgagccgacgaggccctgcatggtcgaggccagggactcgaacgccgccccggggcaggccagggacttgccgtcgaaagccaggcaatactcccgctgcttgccgccgacctgatcccgcaccagggcagaaaacaacgtttccagggacattcgggcactgacgctgccttcccttttgccatggaagatcacggggtgcgtgatgacaagcccgacattacccgactcttcgtcgacaatcttccaaagcagtccgtcgttgtcggcctccataccagaaggggccagggcgttgtggttcgctgcggcagccattccgccttgttccaaacgaacgacatttgtgcccgtttcgtcccgcaaggtgatgcattcgaagatgggtttttgcgccagcaccttttcgccgagatacttccggaaactggtctctatttcctgaatgctggccaggaggccgtaccgtggggacatacccagggcaacgttctcaaaataactctcaaccgggcggctcccagccaaattttgcatatcgctgcggcgctcctgaaagaaatactccaggttcgctgccaagttggccgtatcccaacgaaactgctccagggccagcgactcgtgctgcgcactggcagcatgggtcctccaaagtaaggcagacatggctcctagaaaaagcactgcaaagatggtcaacaagacccagccctgagttgctgacctttcgccgccccatcgcaggcgaggtcgaaatggatttgtcaggcgcttcatgatctaatttgcgaaatacgccggataataacgattgagcattgggtagtacctgttgactagttccgcaagccggcccgagcgcttgaaatctgcgaaaaacgtgttgaactgcgccaacagttcgggctggtccttggcgaatcccacggccatttcctgttctgagcttagcggacctatgattttgatctttcccggatacttctgcagggcgaccatggcgtcgggtacgtcgagcaaggtggcctcggcatctcctataatcacggccggagcgagatcgttgagggatccggggaactcgctgcccttggccccggcggcgtccaggttgaacaatcgtggatcaaggcaggtgccggccttgtgcagcacggacagtccgtttaatttctcgcgggtcagggtgatgtccttgttcgtgtcccccgtgggaacgataggagtgagcgaggagtcagcgcgcaccacaagccagacctgtgttgggaaggtcgggctggagaagttcaggagggccttgcgccagccgagaatcgtcaaacccgtggccagcacatcacctgtaactggcgtttctccggttaccgcaaccccgcttccttcaatggtaaagtttttgccggtaaggctttggatagcattcacccaatctgtggcaatgaactcgtagtcaacgcccaggtgtttggcgaaagcctgcataatttcaacgtccaaaccctggtccttgctgatgatgaatcccgcgtagggcactcccaagtggcgcaatgtcccggcggcgcgaatgtcagccaagtcccgagccaagacgcctttggtcgctatgatgacaaccgaaagcatgcatacaaaagcgaacaggaacaatggccacaatttgacggaatttcgcggcgtcatgataattcctccattcgggctgtcggtggactttgcttagtggacaccatatacatgacaggtgctttgcgaaaggggagaaactgcggcattaatacggatagaatacggagaacggctaggcaggtttgcaatcgtttttagcgggcgtgccctccgccggtccaatcacgttcggctgtgcgttcggggtgtaaccgggagtaatcgttgcatgacggaaaaaatcctcctcgttgatgatgaacggaatgtcctggacgctctaaagacagcgctgcgccgggaatttgacctctacaccgcacaaggaggtgcggaggggctgaaatctatgggacgaaacgggccatttgccgtggttgtttccgactacaaaatgccaggcatgaacggcgttgaattcctggagcatctccgaaagctggcccctgactgcgtacgaatcatactgacgggccatggcgatctggagtccgccatcgcggccgttaaccaaagtgaggtcttccgttttttaaccaaaccatgccctacgcaagtgctctgcaaagccttaagagacggattgacaaaataccgacgagacgtgcttggggtcaaagccgccgatgcactcctgagagtactcagcggcagcgaggcagaagcgttagcggccgagcctgttttgggtgatgcgcgcctaactcagcgcgaaaggtcaatcgcggccagaattcgcaggggcaattcgacgaaggagatcgctgaagccttggacctttctccgcgaacggtcgaaacctaccgtgacaacattcgcaagaagctcggcatcgccaacaagaagatcaatttgaaaagttacttatcgtcggcattttgattcggacgcggatgcaaccacgtgcgttatgtcagtctcataagtaatcaactccttcaaaaagtcgactttgctctttagctgggggacacccggttcttcattttcatcaagccaatgccttatatccacgacaaaataccctgacataccgaatactccactgttggctaatacttcttcgcccgaccctggtactttccttcactgtcgtatatcttatactcgtcaccatcccgactttcttttacacgcccctcataatgcccttttgaatcatagatcttatcgtcttttatgcgtccctggtagtatcccttgctatcgtaaatcttgactgtctcaccgtctcgactttccttcaggcgtccttcatgctgaccacgagcatcatacatcttcccgttatttactcggccttggtatcggcctctctcatcataaatcttgtagttatctttgtcgccattgccgcgagcccatgctgcttcaccatacagggcacaaagcaagacgacaaaaagcgccacaaacctcagcaaccatttgatatgcatagaaatcctaaaaacttgcaccaccccacgttaagcaccacatctcgtcaccttctgcacaacaatctacaagcatcccgtggggtaaaatgcccaaaaaatggccaagatgctgcgtagggtggtaaatcaaaaaatcaaaccctgcactttttcgcaccaaccctcaaaaatcaggcctcaagtggtaaacaagcccttctctgccccaccctatcatcaagccccactcccttttcagaatggggctcttcctatctcagttgaccatccccaggatcatcccgccgacacgctgcagccgatagccactctctgccgtcagccgaggatactgggccgccttggtgtaggcgttaatcacatggaacatggtctcgccctgctcctgcggccatgcccattcaacagcttcaacctcgggctttcccaattgaaactgccggttaaatgacttcatggtcgcaatcggctccttcacttccgactccagggaaaactggagcctttgcttctcatccaacagcttggcaccgacatcgccaatggccgtggggaactcatccagaatccgcgtcgaaatgtggcgatacgaagcctcgacctctgtcttcgaaatgagcccattggtgcacaccagccgcaacaggaacgccgaaatggataacgccgccaatccgatctcggaattgccaatggaaatcccgggccttaccagcgtgttgaaaaactccgccaagtgaccgagaatccagccatcgcggttccggaggtgatctgatggggcttggccgtcagggtgatcagcaggggacgatgtatctggcctgggatgagattcctcggtctcgtgggcacgctttttacgatcgtctccagcagactctccggaaagccgccttcgatggtttcgccgagaagctgtgcaagcccttctattccgacaaggggcgtccctccattccgcctggccggtattttcggatgcacctcgtggggtatttcgagggcatcgacagcgagcgcggcattgagtggcgctgcgccgattcgctttccctccgggattttctccagctttcgcccaaggagtctgtgccggatcattcctcgctcagtcggacacggtcccgtctgccgctggcgacccaccaagaggttttcacctgggttctcaagctgctcagcaaggatggcttggtccttggaggccgcattggcgtggacgcttcgaccatggaggccaacgcggcgctcaaaaccatcgtgcgccgggacacgggtgagagctaccgcaagatgctcctgcgcatggctaaggagagcggcatcgactctccgacggatgaggatctggctcgcatggaccgcaagcgcgtcggcaagacgctttcgaacaaggactggcagtcgcaggtcgatcccgaggcgaagatcgccaagatgaaggatggccgaacgcatctggcgtacaagccggagcacgcggtggacctggacaccggcgcggtcgtggcggtcgaggtgcatgaagcggacaagggggacacttcgactctgcaaaagacgctgaaagccgctcaagaaagtttgcgacgggtcacttccacaccgccatgcccggacgatcctgcggaactggtcgcggacaagggctatttctcccgggatgtcctcaaagacctggacggagggccatggcggacgagaatcgccgaacccaagcgcaacggcctgaactcctggcgtggcgatcatgaggcgcggcgcgccgtgtacaacaaccgaatccggatatcgtcgatggtcgggaaggccatgggaaaacagcggacggaactggtcgaaagaagcttcgagcatacgctggaccggtctggcggtatgcgccgggtctggctccggggacgggagaacatccagaaacggtatctgctccatgtggccggtttcaatctcggcctgctgatgcgggtcaagaccggccatggcacccccaggggctgggccagtgcctggcttgcgctcatttggcccaatcagcatccctcaatggcctatttggccatcgtcatggtggtcgaaggacgatgctgtggaatcatgcccatcgccgtcatctgcgggggagaatagccggaaacagctttttgcaacggcctgttacgcgatcgtttccattaacagcaaattcctgcccttggtcaaggatggagagcgacatgaactcgtgatccaagtggcattgcacctcaagctcctcgccaaagcccatctcggcaagcttgtgcaaaaccgtcacgttatccacaggcacgtagcgaggggtaaacacagcccggacatcatcaccgtcgaagcgaagatacagatcctcattgcgttccctggccaaccaatggttcaggttctgcgcttgcaactccggcgggcacttcttcagatattgcagcggcacacctaaccgatacgacaacgagcgctgggccatgtgccgcaactcatgcacctccgtgccgattcgaatcgattccaagccattgaattcgatatgacgcaccggcacaatctggtcatggcagtttacggacatctgttccaccttctccatcaccttccccagggtcgtcagcttgcctttcacgaccgcacctcctgaccgctcgacggcacgacaccatgcccatgaacctccaccactggttcacagggaatcgccacggccgccgacgcttcgatgttgaaaatggccacggccaccggcatcgaaatggtcgggtacagggactcgacttcccgaatcaccaactcctttgtcgaaccaaacgggctcttggcgctgcgttcaccggtcagcagtaacaaaccgacatcgattttccccaggtcatacccgagctgcagtcgaacgaacccttcgaggatgtactcataggcgtgaaagttggcctcaatggcgatgcgctggagacagcccttgtactgatatcggcggccttcgatgatgggcaggtttccattgtcacgccagccgcaatcttccaaactgctcttgagccgacgtcctttgtacggcgactcaggaagccaatcatcgacgtacccaagggtatccttgacgatattggtcatccccttttcctcgatgaccatcttggaatctctgaaatggagcaattcataagacatagaagcctccatcatgggcttggaacttatttttgtgagccatgggcagccaggtcgccggtcatctcatcaatgaagatggatcttttggcgggctgtcccaggtagttgtgcgagtaggtcacgtagagccggtccatggcgcgggataaggcgacgaagcagatccttctctcctcttccaaatcgccgcgcttggtgggcatgatgccttcgaccaacccgaccacgaacaccacgggaaattcgagtcccttggctttgtggatggtcatcagcttcacgccactggggtcgcggctacaggtttcgtcttcaaccgtcgccacataggtcaggaactcactgatggacgcgtaccgggccgccgactgcagcagctggttcaggttgagcacggcctggttgtcaggagagggaatatccttgtcagtgacgaaccggtcgtaatccaggcgctggcgcagcttcgccaacacctcggccggccccatctccccttcattctgaatgaatgattccataagtcgtacgaactcatggacatttctcctgatgtaggggctgtcgaagtccatggtgcgaagggcttgatacaggctacaggcagattcattggcaaccccagccacctgctccatgaacttctttcccaggtatctgttgggggcattgatgatccgttgcaaagcttcatctccggccaccgaatcgggatcttcaatgaaacgaagataatcgagcaggattctaacctcacggcgctcgtagaagctcatgccgttgtcgatgtagaagggaatgtcagctcgcacaaagacgttttgcaatatctccgactggaagttagcgcggtaaagcaccgccatatcgctatacgctgtgccatcagacacactcaggtgcttgatctcattggccaccagacacgcttcctcttcctcgttgaaggtgtcgatgacaaacaggtcatggttgccgccgggcttgtgcgcgataagctccttgggaatctttcgctggttatgatcaatgagcttctgacacgcagccaggatcgccggggtggagcggtaattgacgttgagcacgatctcctgagccgaggggaatatctgcttgaaccgaaggatgttcccaatgctggctccgttgaacgcgtagatgctctgccaatcgtcgccgcaagcccaaaacgagccccggccactctccgcaatcagcgcctggagcacggccaactgcgccggattggtatcctggtactcgtcaacgaggatgtggggatacacgtcatggtatttttcagcgccgccctcatgggccagaaaccgatacgcctgaaggagcaggtcatcgaaatcgtagagataccggatggtcttttgctcctcatattccttgaacaccatggccgtcttctgcttcgattggtcctcaccgtacaaatcaatgaactcttcagggctgatgcaattgctcttggccaagctgatatcttgcaacaccccgccaatggccaagtctttgacccccaatgagcgcatgatcgtcgccaccatggtcatctgttcggagcctgagacgatattgaagtatcggccttcggatttgagcagccgcaaacaaaacgaatggatggtatacaagttgacacgactggcttcaccgtggagaacaagttccaaacgttctcgcatctgctcggcagcctgacgggtgtaggtcagccccagaatgttctccggggcgacgccgtgatcattgacaagccggccaattcgttccgtcatcgtcttggtcttgccggaaccaggaacagcgacaaccagggctatccccgtatgaaactgcgccgcctccaactgtttggcgttaagggacatgatccctccttgttcaatttgcgaaccaatcccgacagcactgctgatacgaacagcctttgcatttccaggacgtgtcattggggatgaacaccccctgcatgatgccccggtagacagcctgaatcttcttcatggctcgaagctcatcttcctccgtgcggactgtgtaatactgctcgaatttgggcttcttagttttgacgagacaatcaaatcgcagcatgatctcccggtcagcatacccgttggccttggcagccatgccgtagatggtcagctgcaggctcttgtcgatgtcatcggaggagtaggagcgactggaggtcttgtggtcgacgatgacgatattgccgccggcatcttcctcgaccatgtccatgacgccgacgatgggaatcggcactccttcgatctgaaatgagaacgccttttccagcccgatgaccttgagcccggtttcgggaaactgggtgacataggtagcgagcagggatttcccttcaagcagcgtcgaatcgaaatccttgccctccttgaattggatcttgccggcctgctgctcaaaagcttccgtgtagcatttctcgaaagcagcggtcacatccatgacggaaagtctggtcccaatagaccgctcatggtggtagagttcgatgatcttgtgaatggttgtaccgaatataagcgcttcggcaatagcctcaggctcgcgcttgtcgatcttggcaaacttgaactgcaggccgcagtcgaggtagctgttgatcgacgatgctgacagatgcccaatttcaatcgggttctccataggaaatactccaggcaggaaccgctcaaaggacgcaccaatcccttcaagcggttcccgctcactgaataatgatcgttgtgtacgagggagtcggctaggccgattgctgcaactggcggatgaacgcggcagcgtctgagggagtcaggtagtcaagggctacgccaaaggcttcgagcgccatgccgtcgagatcggcttcaacgatgccacggcgtctggacaggctggcaatggcgcgcttctgggcttcgctcatgcgaacagcggcatgattctctacctggttcccgttacccgaaggccgaggcgcggaaccaacctgaggcttggccttggcatctcgttcgttgggtcgctggagaggagtcaccggcttcggctcttcctgtgccgcgatcggctgacgattggtcgcttcatggacatgcccacgagattgcccgcctgacgcgtcggagacttcatcacgggctttgcgctgcggcgaaggcttgcggccaacgtaagcgctcaataaggcgcgtcttgttagggcgagcaggaagcaggataagctcaggcaggtatgatgaggctttgaggatcgctgtactggggcaggagggccttgcgttgggcgtcagtggttgccgccggcaagtgctcgaagaggtggcgcaggtagcggtatggctccagcccgttggccttggccgtttcgatgagggagtagatggtggccgaggcgtcggctccgcgcggatggcctgagaacagccagtttttgcggcccacggcaaaggggcggatggcgttttcggccaggttgttgtccggacgcagtcggccgtcttccaggtagacgaccaaccgctcccactgtttgatagcatagccaatggccttgccgagcagactcttgggcggggtggtggcggcgcgtgcatcgagcagcgccttaagcttgtccaggatcggcctggatttttcggctcgcaggaccttgatctgctccggattgagctgttgcctttcggcttggtgctccacgccgtagagtttgccgatcagatcgaggacggcatgggccgtgccgcctttggccttcttgccagcggacttctcgacctcgacgaacttgcgccggacatgggccaaacagccgagatggcgcaggccttcccgttcgcccagggcctcatagccgctgtagccgtcggtctgcagatagcctttgaaatcgccaagaatttccgcagccacgctgccggcccgggtcggatgatagcgaaacaggacgaccggttttcccggtgttccgccccgggcgacccacataaatgatttcgtggtgttggcccggcctggttcggcaagcacctggaccgtggtttcgtccatgttgacgatggggccggaacgaatttcagcgatgatcatgtcgatgagcggatcgcaggacttggctacgcggatcatccagccagccagggttccccgggagatgtccagccccaggcgagcgaactgatcctcctggcggtacaggggcagcgcgtcggcatacttggccacggcgacatgggccaaaaggccctgagtcacgatgccctgggggatgatttggggtggcatgggcgcggttttcaccgtcggcccatcgtcctccacaccttcgcaggtacggcaggcgtattttggccggatgtggcggatgacctggattttggccggcacgatgtcgagcttttcgctgacttcctcaccgatgcggaccagctcagcgccgcaggggcaggtcttctccgattccggcaggtcgtggatgatctccacccggggcagatccgcagggatggggcgacggccgcgtttgcggcgggtgctcgccggggcgcaggcctcctcgaaggtctgcggtttgtgctcctccgcagtctgctcggcctcgtcgaacagggagagctgctgctcctggccggtacggggctttttctcggacttcgggccgtaaatgatcaggttcaggagctgaaggcgctgctcaagttggacgatgtgctcttgctggtcagcctgactggcagccatgttgacaatgagagctttcagtgcggcagggtcgtcagggagggaattgatgtccacggcccgaacaatctctcattattattcaatttaatcaaggcaatactgtctaaaagagcgtcgaatactccagacgggagtgtcccgtcacggccaggggatcgagaccatcaagcagccaggccagttgccgggagtcaatggcaagcacctccgcctcgcgggttggccagcgaaacacatgccgctccagacgcttgtgccacagacaaaagccgttgcgatcccagtagagcagcttgatgatcgtccggctgcggttgcaaaagccgaaaaggtgaccggcaaacggatcgagttgcagctgccgtgaaaccaggatggacagcccgtcgatggacttgcgcatgtctgtggctcccagagccaaataaacccggacgccgcttaccggcgacatcatagccgtgtcagcgtgcggacaagcttttccagcaccggcgcggcgaagttgcctctgatctcgatgcgaaaggcgttgcccacgtgcactaggatcggtgccggcacggttgccatgtccgcctgggccgacgccggcagaggcacgggaacgagggtgacgcaggacgcgccctccttgccagtcgctgcctccaaacgcttccgccaatagcccatggaactttgggaaagaccctgccgccggcagtaagccccctggctcaggccgctacgatgccaagcctcaatatgttcagaccagtacgccgccttctcgaaactgagctctgctgatgacgctgccatggtcgccctcctgtgggataaaccatgacagaaaactcaagcggcgtaagaaggggttgattgaccggttaccgacaaacgtatctggcttgtcatagacaacagatcaaccccatgaattttcgtaaaaagctctctcgtattgcttaagggacgcgacaccaaccctttcctccgcccttttgcccaggtccccgggactgcgtcctgcctgcaacgcccggtagtccccactttctggatttcccaacagcccattccatgcttcgtggaaaaactttgcttttttccacagagcccaccgataggaatcatggaatgccgtcgccttgcgccaaccctgttgacttttttcacacaggcacgacatctgcaaagttctggcaaaccccaaacaggatgtcccatgccgtatccgatcctgtcaccatcgtgccgtgcgcttgccctgtgcctgcttgtcctggcggcctggccgaccgcccccctcgtcgccgctgaaaacgccgtagcccatgccgatccctacgccgcctggaacaaggccggcctgcgcaccccgccgccgacgccggtgcaaaccgtttccgtgcgcgactacggcgcaatgggcgacggccggcacgacgacagcgccgccttcgagagcgccgtggccgccgtggccaagcccggcgtggtcgccataccggccggaacctaccgcctcgcccgcacgctcaaactcgcaagcggcgtggtccttcgcggcgagggggccaaggcctccttgctggtcttcaacatgggcgggacagccgatgcgcttattgacttcaccacctacaactcccgcagttggtccagcctgacccaggacgcgccgctcggcgcgtcgagcatgaccctgtccagcgcctcgagcatcgtcgtgggcgacgtcatggagatcgagcagcaaaacgacccggccaagatgtataccgacccggagtggaaccaggactgggcgcaaagcgttgtgggccagttcgcggtcgttacggcgatatcgggccagaccgtgtccctggacaggccgcttcgcgccgcttacgccacgaacctgtccgcccgggccagggtctaccgtatgggaaaaaacgtcggcatcgaagacctgtccatccgccgcgaagacccgggcagcgccggcggcgacaccatccacttcaagtacgcctttaactgttgggtgcgccgggtggaaagcctcgacaccgtcagcgcccatatctacgccgaatcttcggccgccatcgaggtgcgcgactccaccttcaagcgctcccacgactacggcgacggcgggcgcggctacggcgtaagcctgggccgccacgtgtccgactgcctggttgaaaacaacgttttgagcaccctgcgccacgccatggtggtgagccaaggggccaacggcaatgttttcggctacaacgcctcaagcggtcgcaagtgcgagtccgacgcctggacgccctgcgacatctcagtgcatgggcactatcccttccgcaatctcttcgagggcaatctcgtcgaggagatcgacgccaccgactactggggtccggccgggccgggcaacgtgttcctgcgcaacgtggtcagccaggaaggcatcgaaatcatggacgcttcccacggccaaatggtacttggcaacctgctcctgtccggcggtccgctgcgggtggagcagggcatcaccgacgtcgtgctcactgccaacaccatcctgccggcaaccagcgccgacggcggctgcgacatcaccaccgtgccggatagtctttaccttgccgccaagccgtcctttttcgcctccgcctcctggcccctgctggccgacgaccagaccgccaacccagcctccatgcgcgccgccggcggcgctttgtcgccagttaaacccaatccgggcctcgtttacgccatcaatctgctgttgcagtgatcccccagccatccggcgctccattcctgttcccaagcagggcttttacgccccgggccgacaaacgccatgccgcgccatacggggccaccttcgcccacacctcccaaacgccgctatttcagacctgctcgggccgccgcgacaacgccaaccgtccgacttgcccggcggccataaaaaaggccggacgcgttcccgcgtccggcctggcattcgtgtcgtggacctctagaaccgctcgaactcgtcgtcgcgagcatcaaggtcgatgcccacgccgctggcgggcttggcggccgcgccggacggacgcgccgcggcagcaggacgccgggccgccgacggcagggccttgaccggacgataggccgtgcgccgggccgtggctccgtccacccggaaaaaggccatggtggactggagctgctcggcctggctcgaaagctcttccgaggtggaggccatttcctcggaggccgaggcgttttgctgcaccacctgatcaagctgctggatggcccggttgatctggtcggccccggaattctgctcctgactggcggccgcgatttcctgcacgagatcggccgtgcgctggatgtcgggcaccatcttggtgagcatggaaccggcccgctcggccacttggacgctggacgacgagagttcggagatttcggcggcagccgaaccgctgcgctcggccagcttgcgcacttcggccgcgaccacggcgaagcccttgccgtgttcgccggcccgggccgcctcaatggcggcgttaagggccagcaggttggtctggcgggcgatctcctcgatgatggaaatcttctcggcgatgttcttcatggccgccacggccgagaccacggcttcgccgccctcccgggcgtcctgggcggccttgacggcaatggactgggtctgttgggcgttctcggcgttctgcttgatgttggagctcatctcttccatggacgaggagatttcctcgacgctggccgcctgttccgtggccccctgggacatgctctgggccgaggccgagagttcctcggagcccgaggccacgttttccgaggccgactgcacctcggccacgacctcgcgcaatttgcccaccatttcgttgagggacgcggccaggatgcccatttcatccttttggtcgatgtcgagcagccgggtgaagtcgccttcggccatggccttggcgaatcccacgcccttgacgaccggtccggtgatggccttggtcaggaagacggcgatgaccacgcccaggatcagcgccacggccaggccgcccagcatcaccgaggaggcggtttccaagctcgaaacggcgtcgacggcgatcttcgtggtggcgtccatggcggccttggccgtgacctcggccgcgtcctggacagcgttggccgcttccaggcgcttggccgcgatatcctgaagggccttgaaattatcgagataatccatgagggcttggcggtatttctgggaggcgtcgcggatggcggtcagttggcgaatgttggcttcgtcgcgggtcttggatcggatggcgtcgatagcctggtcaagttggccaaaggctttgacggcgtcctcaatgtgccgggggtcgcggaaaagctggccccggtagttgccgacccgaatggcggtgatggcgcttacggcatcactggcgccgtcgatcttatccacccgctccagcaacccggcagaggcgacacctgaaccgatctcctcgcggatcttcttctgctggctttcgagatagccctcgctgtttttgacgatctccgccgcagcgccgtccaagattttgcgcactccggcgatggcctcgatgcgggcatgggtctcggcgatgagcttttcgtattccgctgccttggcctgggctttggccacgttgtcgcgcaactggaccagttgggagtacttgtcggcatgggccttggcttcgcccaaggaacgcttgaggtcggcgaagttgcgcatacccgcgtcaaactgctttttgtcctcggtataaccgtaactgcgcatttccagcatggtctgcaaggcagcccgctcgacgctgttggcgatggccagttccgggatgtactcttgcaccaaccgcgtggattggctttccacgccccgcatgttgaacacggccatgccccccagggcgcaggcgatggcgatcaggagtccaaaaccgatgctgattttgacgccaagcttcaaattcttcactgccggcctccccttgacgtggtggtatcccgcgcttttcagtttctgatacggattcgggacctgggcgcggtcgtcctcggattgtttgtttctggcctattttgatgcctcttgcaacgcaaacctcacacttttacgggcatggaccattgcctgcgtttccagtaggaaatctcacagaggagttgcgccatgaaaagcttcatatacgagctgttgttagcggcgcgcctggcccgccgcgagctgcgggctgggctgcggggctttggcgtcttcgtggcctgcctggccctgggcgtggccgccgtggccggctccaaaagcctgtccgccgcctatctggccggcgtggccgaggacgccgcagcgcttcttggcggcgacgtcgaagtcgccttgtccctgcgcccggcctcgcccgaagaaagccacgccctggccgctctgggcacggtctcccatgtggtcaccatgcagaccatggcccggggccgagatgacaacgccgggcgcgctctggcctcgctcaaggccgtggacgggaactatcccttatacggttccctcgacctgtcaccgcccatgaccgcctccgaggccctggaggcgcgaaacggcctgcccggcgcggtcgtcgccccggaacttctggcccgcctgggcgcgcgcctgggcgacgtcatcctcgtcgccgacgtgcccctcgaaatacgggcgaccatcgtccgcgaacccgacgcttcgacgggcctggtgtccctggggccgcgcctgctcgtggcccagagcgccctcgaaggaacgggccttatcggcccgggcatgttcacccgccacgcctaccgcatcaagctcccgccaggggccgaggccaaggccgtcgccgcgcatgtcaaggacgcctatcccaaagccggctggcgcgtgcgcgatctggcctcggcccagcccgggctgacccgtttcatggaccggctgggggccgtgaccgggttggtcggcctggcctcgctgcttttgggcggcatcggcgtatcccaggccgtggccggctatctggggggacgcgaaggctccatcgcggcgctcaagtgcctgggcgcgccccggcgggtggtggtttggacctatctgctggccgtggccgcccagggctgcctgggcattgccatcggcctggccgtcggcgcgtcgctgccggcgcttgttgctcccctggcagccggggcgctgccggtgcgactgccgcccggcccctaccccgaagccctggccctggccgccgcctttggcgcgttggccgttttggccttttccctgccccatctcgtgcaagccggccgggtctcgcccctgctccttttccgaggctacgccccggccggaaacggccgtctgccctggcgcgacgccttgccgggtgtgatcgccctggccgggcttttcgccctggccgtgctggccacgcccaaccgccggctgggcctgggctttgtcgtggcggccctaggcgcggcggccatcttccggctgctggcctcagccacggtgcggcttgtgcggctggcgccgctccatcgcccgggactgttctccctggcccttcgggccgtggcccggcccggcaaccaggtggcccgggtgctggccgccctgggcctgggactgtccaccttggccgccatgacccaggtggaagccaatttccgccaggcctttgtggaagacatcccgaaaaccgcgccggactactttttcgtcgatgtccagccgaaccagttgccggcctttctggaaacggccaggggcgtggccggcgtcatccgggtggacgcctcgcccatgatccgggggcgcgtgacggccataaacggcgaagccccggacgagtcgcgggtcagcgaagacgtgcgctgggccgtgtcgggcgaccgggggctgtcctttgccgcggccatgcccgagggcacgcgtctgatcgagggggcgtggtggcccccggactatgcgggcgaaccactggtctcggtggaggaggccgtggccaagggcatcggcgtcggggtcggcgacacggtgacggtcaatgtgctcggccgggagatcacggccaagatttcgagcctgcggcgggtcaactggctgacccttggcatcaactacgtctttgttttctcgccaaacgccctggacgggctgccggccacctggctggccacggcctacaccgacaaggccgccggcaaggccccgggcgaggcggtcttcgccgccgtcacggaacgcttccccaatgtcacggtggtcggtatcggcgacgccctgaccgaggtgctggccgtggccgacaaggtgtcctcggccgtgcgcgccgccgccgccgcaaccctcggggcggggctgctcgttcttatccagtccctggccgcgggcctgcggcgacgggcctacgagaccgtgatctacaaggtctgcggcgcgacccggcccgacatcatgacggtgctgtgtctggaaaacgccctgcttggactgttggcgggtctggtggccctggcagtgggcacggccgtgtcgtttgggtttacgacgtatttcatggagttgccgttttcggtctttgccggtccggccgccttggttgtggccgccgccgccgccctgaccctggtcttcggctcggccggagcctttgccatgctctctaggcgggtcttgccgtatctgcgaaacgaataagcgggatcagtcggccccggccggccgctcgggcatgtgggcgcgccgctcggcttcgaggcgatcatagacagccaactgtcgcggcgacaacatcggccgcacctgatcatcaatgcgctggaacacgatgtcgatatccgggcgcatgcggcccagggccaaatcgaaatcgcgccgaccgttctcccaggcgtcgaggtagacgcggcgctgctcgggactcagatccagacgccgcatggactcgtcggcaaaccgttggcgcacttcctcaaaacccgcgccatcggtggcccgcctttccagcaacgcctgacggctcgacagcagccagcccaagccgacgccgacgatcagaaccgtgacgaggcttcccgccccgaattgccgtgaaccttcagccatggtctttctccaagaatgccttgagcttgcgcctggcgcgaaaggcccgcaccttgacgttgacccgggtcaatcccgtgagtgccgccacttcctcgacgcttttgccctcaagacctaaaagcgcgaccaggagccgatccttggggccgagcacggccatggccgcctccagacgccttctggcctcacgcgcctcacgccgggccgcttcgccttcgtcgggcaaggtgtcctccaggccgcccaccagcccgtcctcgatcttgcgccggcgcagccagtcgatgcaggtgttggcggcgatgcggtgcagccagccgcgaaacatgccccagtcccggaggccgcccaaattgaggtaggccttgacgaacacttcctgggccagatcctcgactccggccggatcccggcaaaaacgggaagccagatgggccacgcccggtccatgccgcacgaccagcgcggcaaaagcttgctggtcgccctcgaaggccgcccgggccaaggcagcgtcgtcaatgccttccagacgcggccggggacggccggacacgccgtctttcaaccgaacgcatttctcaccaacacgcgtcgtcatgcagcaagcctccgccaacgcccctccccaggcgcgtttgcctgctcaggcgtcgagcgcagcccatcggttacacgcccgcctcgacaagccgcgcccggcaggctatctgcactgccggcggccgcgtcccggccgcacgccacctcccggagcgagccatgccccttgccgccgacaccaacatctacctcatcggtcccagggcctcgggcaagaccacgcttggccgcaaactggccgaaagcctcggccgctccttcgtcgatctcgacgcccggttcgtcgaagcgcgcggcgaaaccatcgccgaactggtggcccgggagggctgggacgccttccgccgggccgaagcagacatcctggctgaaaccgccgcccaaaaagggctggtcgcggccacgggcggcggcgtggtgctgttgccggaaaaccgggccctcctggccaaggggctggtgctctacctgcaagcccaccccgaccgtctggccgagcgcctcatggccgatctcaacccggaccagcgccccaatctgacgcagcttggcctcaaagaggaaatcgtggccaccctggccgaacgcgaaccgctgtatttctccctggcccacgcctgcctgcccgagcgccccatcgacgaattgctggaatatacgttgcgcgcgctcaaaatgttctaggggactccaccgtgcctttggccgagggcgcggcggcacaagcgcgcgaaaagggctgctttgggcgcgagcatagctcgcgcccaaagcagcccttttcgctgacgagttgggggctgtaatgcgccgtttgcccggacataagccgtccgggcaaacggcgcattacagctctcgtcttctctcgggcgaccgcccgccgacgtctcttcgcccggccgaccggagcccgcaaacagggggcccggggggaatgattccccccgaccgccggaaactcttaaaactctcccactactcccttacaaccaatccagcccgatcacatgcacggccagcggcccgtgcacgccgcgcacgtaaacgaattcgatgtcgccggtgctggacacgcccgagacacagttaagtgcgctgggcatgggcccctgccccacccgctccagcatggtcggcaggtcgggcacaagacgcgatctggccacgaaggccacatgcaggcgcggcaccagcggtgtgccgcgctcacgtcccggggcggcggccatgacaaggctgccggtggcgcacagggcgtaggccacggccgtgacgccgagatccacggcggccaggcccggacagacgcgctcgggcagctcttccggggcaatgaccgcgaccttggcctcggccaggacgccggcggccgagacggcgtcgagatcgggatggtcccagcgcacggcggttttcacgtcgttggcggccagataagcggtcagcgcctgtcgggcctcctcgggggtgcgggccatctcaaaggtaggcccaagggtggtcagcacggcggcgaagcgctcgaaatcggccacgcccccgcccggtttgcggggaatggtcggggccgagacacgggggaagccggcggccgtggccgcacgcaggcgaccgaggatggcgtttttggcgcgcgttttcatgcacgtcctccctggagacgcttaagccggcgagcgagggccttgaatcgccgggagaaaggccgggccagccccgggaactcccggcagcgcaggaagcggcccaccggcgcgtccggggccacggccgcgacctcgcgcagcttggggtcaaacaggcggccaacggcggccgcgccgccaaacaggagcggatgccgggccagcaggctgaaggccgccaccggcagatcggtttcggtctccgacacgcggcggcgcagttcctggagcagggccggatggtcgatgccggccgggcaggcttccgagcaggcggcgcagtgggtgcaggcgaatggctggcgcggatcgccggggttgtccttcaaaagcggggagatgaccgagcccatggggccgggatagaccgtgccgtaggcgtggccgcccacgctctggtagaccgggcagacgtttaagcaggccccgcagcggatgcagcgcaggatggagcgcagcttgggatcggccaggatgtccgagcggccgttgtccaggatgaccagatgcatttccctggggccgtcgcgttcgccctcgcgccgcgcgccggtgaaaaaggacaggtgcacgggcagggtctggccggtggcggccggcggcaggatgtccaggaccacggcggcgtcggccagggtctccaccactttttccagggtcatgagcgcaatgtggatgggcggacaggagccggaaagccggatgttgccctcgttttccagcaccgtcaccgtgccggtctcggcgatggcgatgttgcagccggtgatgccggcgtcggcggccagaaacttctggcgcaggctgtcccgggcgatgcgggtcatctccgggatgtcggtgctggtgcggccgaacttgcgggcgaaaaggtcggagacctgctccttggacacgtgcagggccggagccaggatatgcgaggggcgctggccggccagctggatgatgtactcgccaaggtcggtctccacggcctcgatgccggccgcttccagaacctcgttgagccccatctcctcgctcaccatggacttgcccttgaccacgagcttggccccgcgctcggacaggatgcgggccacaagcgtagctgccgtctcggccgtttcggcgtagtggacccggccgccgacagcggtaacgctggcttcgagcttttcgagcaactccggcagcttggccagggtcttgtcgcgcacggccacggcccgggcctggcgctcggcgaagtcgggcatggcgttgaccgagcgctggcgcagcacgcggatgtggccgatggccttgtgcaggatggcccggctttggcggtcacccagggccttggccgaggctttggcgaaatcgtgggcggtcttggtcatatgccctccccggccaggacctcggccagatgcaacgcccgtatcggcaggtcgcgcttggccatggccgaagcgatgttgagcaggcagctcggctcggcggtgatgaccgcctcggccccgctggccacgatgtcgtcgattttttccgcaacaatggcttcgctggcttcggggtagtcgatgctaaatgccccaccaaagccgcagcagcgctcgggccgggccaaggggaccagcgtcaggccggcgaccttggccaacagcgcctcggtggccgatccggccccaagcacccgggtggtctggcaggagccgtgcagggcggcggtcaggtcccagcgcgcccccaggtcggtgagccccaggcgttcaaccaggaactggcccagttcgaaggtcttggcggcgacgtgggcggcctgctcccgaaacgggtcatcctcggcgaaaagcgagggatagcggcgcaccatggccgtgcacgaacccgagggacacaccaccaccggcgcgtcctgaaatatttccacgaaccgccgggccaggggccgcacgaggtcggcccggccgcgcttgtaggcgaactggccgcagcaggtctggcccttgggcagcaccggcgtcaggccggcccggaccaaaacggccgtagtcgcctcgcccacttgcggcaacacgtgttcgaccagacagggaatgaaaagaaacgcttccacgaaaagccctccttgcaacggggcgacaccttacgctttagacccgccgggtcaaggccacaggcggcttgccggcccgcccgctttacaggaagggggtccgttgctatggacacccgttgcaacagataaggaagcgccatgaacgaagcacccaccgccaccttgacctatgacggcaagactgtcgaactccctgtcatcattggcgatcacgtcgaaaaggccctggacgtgcgcaagctgcgcagccagaccggctggatcaccttcgatcccggctacgccaatacggcggcctgcaagtcggccatcacgcatatcgacggcgaaaatggcgtggtgctctatcgcggctacgaccttgaagagcttgccgacaaggccaccttcgtggaaacggccatgctcatcatgttcggcgagctgccgacccgggccgagcgcgaagaattccgcatcatgctgcgcgaccaggaactgttgcacgaagatctgttgagccacctcgacgggtttccgcccaacggccatcccatgtccatcctctcggccatgatcaacgccatgggcagctactatcccgaactctacgacatcggctcgcccgaggacttccggctggccgccgccaagatcttaagcaaggtgcgcaccatcgccgccttttcctaccgcaaatcccaggggttgccgctcaattaccccaaccccaacctggattactgccgcaacttcctgcacatgatgttttcggtgccgttttggacctaccaagccccggaccctgtggtgcgggcgctgagcatctacatgctgtgccacgccgaccaggcgctcgacacctcctgcgccacggtgcgtatggtcggctcaagccaggccaacctgttcgccagcgtgtcgtcgggcatctgcgccctgtggggccgccagcacggcggagccagctcggcggcgctgaccatgttcgaggacgtggtggccgggcgcaccaccgtggagcgcattttcgaggcctcgaaaaccagcgccggccgtctcatgggctttggccagcggcttttccacgtggaagacccgcgcgcccgcatcatcaagcgcacctaccaaaatctcgtgaaaaacggctacgccaagcgcgacgccttccacgacatcgctttggagatcgaggaacgcgccctggccgacgactatttcgcctcgcgccagctcttccccaacaccaacttctacgccagcttgctcctgcgggccatcaacatcccgccgcgcatgttcccggtcatcaccgccatcggcaacatgcccggctggatcgcccactggaacgaggagacccactccccggaccagcgcatccaccggccgcgccaggtctacatgggccgcaagcgccacgcctacacgcccatggagaagcgcaagtcctgattcccatgcgcaacagccgcccggcggccgacccgcgcccaagcgcggcggccgccgtcccaaacccgaccggcgcttcggcgcgccgccgcgggtttgctccgttccaggcctccggcgccgtcccggccggccccaccgacaccccggcttcgccaacccgccgtccgttccctaggacgccccggagagccctcatgcgttcttttcgtctgcttgccttgtgctgcctgtccctgacgctcctggccgtcttgccggccgccctgcccgcccaggacgcggccccggccgccgccaaggccgaaccggccaagacgccggacaagcccgccgcccccgaggccaaggccgacgcgcccaaagcgccggacgctcccgccgccgaggccggcaaggagacggccaagccggccgacaaaccggttgacaaagccgccgacaaaccggcagagaaaaccccggataagcccgcgcccaaggaagccgacaagccggctgccaaaccggccgaaaaacagccggccgccaaagcctcggacaaggccggcgaaaaaaacggcgaaaaagccgaggccgacgcgcccaaggactggcaggtgctgctctccatccaccaggaatcggtggtgcagcaagcggcccggttcaagtccatggaagagctgctccccaaaaacgtgcgcaagttccgctccgagctttcggccctggagggcaagctcgacgaattggggctcatcatcagcctgtccggcggcaatccctgggaactgcgggccgtgctgggggatttcgcccgcctgcgccgggccgtggaaacgcttatcgcgccgtcccaggaaagtcgcgacgaactcgacaagatcgccgccaggctcgattccctcaaagaggagttcgccaagcgcctggaagacgatcccgagcagcccatcgccgacgccatcggctactatctgcgctacgtcaaaagcgtgcgcgcttccctcaccggcgtgcgctccaccctggagaaggaactcggcccggcccgcgaactgcttgccgccctggacaaggccgaagaagccctgcgcttaaaaatccccaaggcctggaagacctactatttcacggcctccaacgaactgttctcccacaaggcctggaacgacctggaaacccgtttccagcactgggccaagtccaacgcctccatgctgcgttccatgacgcgcggttccgacgccgtccgggcccaggccgtgggcatccgggccgcgttggccctggccgtgctggcggtggtgtccgtcatcgccatcgcccgattgcgccgccgcattcccgggctgtacgcgcccggcaaactgcgtctggtctgcctgctggccggctccgggctcatcctgcactgggcggcggccggcgcgccgctgttgctccaggagatcggcaacatcctggccgagatcctgctcgccgccgggttggccgtgttctcgcgctatctggccgaagcctcgggcgcggccacgccaggggccggcaatcccctgcgcggcctgtgggccatgttttccctggggcttttgctccagatcgccgacatcccggaaccggccctgaccacgctgtggatggccctgctgctcgtattcctgctggccacaggccgtttcttgcgccgctatgccgggccgctgaggctcttttgccgggccacgccgcccctgaccatgggcctggccgtcatggccgccctgggctggcagcatttgtcggtgctggtcctggccggctggttcctgcttttggccgccgtgcagatcggggccgggctgtcgcgcatcgtcaccgcctggcaggcccgggccagccaggaaggggcctcggcgctcacgcgcgccatggtttcgggcctgggctttccgctcatcttcctgtcgctgttcctgctggtcctctactggttctccacggaactgggcggccaggaactgttcatggaagccgtgggcttcaccgtgaccatcggcacggtctcggtcaccctgggccggctggcccttattctcaccggctttttcgtcacccgctcgacccttttcgccgtgcgctccttcatccaggacctgccgcgcctgcgcccgggcatcgatccgggcgtgcgcgacgtgctggagactacttcgctttacgtactatggggtctgtacatccttatctccctgttcctactcggcttttccttcaccagcctggcggtggtcgccggcggcttgtccgtgggcatcggctttggcctgcaaaacatcgtcaacaacttcgtggccgggctgatcctgctctttggccgctccatccaggccggcgacaccatccagatcgacgccatctggggccaggtgcgcaaggtcaacatccgcaacaccgttgtccagacctttgacaacgccacgttgtttgtgcccaactccgacctcatcagcggcaagctcgtcaactggacccaccgcgacccgaccgtgcgccgggagatcaccatcggcgtggcctacggctccaacaccgagcaggtgcgccagatactgctcgacgccgtggccggccacgagcatgtcttaaagaccccggccccgtcagtgcagttcaccaacttcggcgagagttccctggacttcaagttgctcttctgggtggacaacgtgggcgtggccgtgggcaccacctccgacatccgcttcgccattgaccggcgtttccgggaagtcggcatcgacatccccttcccccagcgcgaggtgcgcatcgtggccggggccagcgacccggtccaggccgccgctggcgcggccgcggattgatccgagccatggcccaagaggcggcccggggcgcgtgttcgccctgggccgcccggacccgccctggcccggacgccgccttggccggcgggcatttgcacgggacagccggatggttttctgatacggctcaagaaaaggacgccgcatgaaccgaagagtcctgcccctggcctgcctggtcctggccctggccgtcgcgcccggctgcaagaaggccaagagcacggccccggccatgccccaatacgatgccctcgaacccggccccggggccaatcccctggagatcgagcgctaccaattggagcaggaaaagcggaccttgtccgagaatttgagcgacaacctcgaccgtatccaacgcatcaacgcccgcatcatccagatcaacatcgaactgcagcgccagaccaatccgcattactaacgccgcccgcgccagccaaggacccagacccatgttcggattctcgtcgaagaaaaagccccgcctggacgccatcaccgcctttctcggggctggaacccagtatcatggccagttcaatttccagggtgtcgtgcgtatcgacggcggcgtcatcggcgacatcatctccgacggcgtgctggtgctcggcgaggaagggcaagtcgagggcagcatcagcgtgggcgaactcatcgccagcggcagcgtgcgcggcgacgtcacggccagccggcgcgtcatcctcaacaagacggccaaactgaccggcaacatccagaccccgtcggtggtcatcgaggacggagccgtgctcaacggccagctgcgcatgaccgaggccgaggccgttatcctgtccgagggcctggccccctgcgccctgcccgggcagccggccgaggacgtcacggaaacgacgtcatgaaggggttgccaaaagggcctcgtccgtttaatggcaaaacgccgtcacccgcccccgtttaaggagtcccgtccccatgggccaatttttccccgatgccgaccagtttccccttgaagaccagatcaagcaccttggcgacgacgagttgctcgatttctgggaagagacccagtacattgagcgcatgctcgtggaagaggaaaatcccgaagccgaccattcccaagagtacgaacgggtgattctccaagagctgatgctgcgcacctgccgccgccgcgccctggttagcgaacgctagcccggggcgtcgccgccgtcgggttatcgcccgcagttgcggtaaaaagcctccggcggccaaagggcttgtgccctttggaaccccctacttgttatcacgcggctcgtctccttatctctacactcactccctgttgaatccagcgcgtcagccgactgacggcagatctcctgtccggcattgagctgttcatcggcgttgtcgccttcattggtcgccagcggtccatttggacggcctgcaccgcactccggttcgactcccatcctcgccgccaacgccccttcggcctcgtcgtcctgcctcccaggccgccaccagtgcagcaactttaacagtccatcgtccgtgttactggcaacgcacgaaaacgagcctcctactgtcagcggcacagagcgtaaaaaaagagggcggtcacccgccctctttctctcgtcagataaccgatcgccagctacattttgggagccgggcggccgatgcagaagtaggccaggccgaggtcggccaacagctgcggggagtagaggttgcggccgtcgaagatgatcggggccttgagcgtcttcttgatgcggctgaaatccgggttgcggaactggttccactcggtgaccacggccaggcagtcggccttgtccagcaccgcgtactgctcatcgaccacggtcaacagctcgttgcccttgaagtgctcgcgggtgttggggccggcgacggggtcgaaggccacgatacgcatgccggcgtcggtcaggtcgcggatcagctcaaaggacgaggcgtcgcgcacgtcgtcggtgttggccttgaacgccagaccccacaaagccagggtcttgcccttcacgccgccctggggggcgaagtattccatgatccgcttgctgagcacatgcttctgacgcttgttgacctcgtcaacagcggccagcagttccggctcgaagccgatcttgcgggcggtgtcgatgagcgccttgacgtccttggggaagcaggagccgccgtagcccaggccggggtagatgaactggtagccgatgcggtggtcggaaccgatgcccatgcgcacgtcgcgcacgtcggcgcccactttctcgcagatgttggccacttcgttaatgaacgaaatcttggtggccagcatgcagttggcggcgtacttggtcatttcggccgagcgaacgcccatgacgatgaccttctcgcggctgcgggcatagggagcgtacagggccttcaagagttcgccggtgcggacgttgtccgtgccgacgaccacgcggtcgggcttgaagaaatcgttgatggcgtcgccttccttgaggaactcgggattggacaccacgtcgaattcgatcaattcgccgcgctttttgagctcctcgccgatgagcttgcgcacctcgtcggcggtgccgaccgggacagtggatttgtcgacgacgatcttgtagtccttcatgttggcgccgatgtcccgggccacctgatagacgaaggacaggtcgcaggagccatcttcgcggggcggagtaccgacggtgatgaacacgaacagcgcgttctccatgccttcggcgaccttggtggtgaagcgcaggcggccttcagccacgttgcgcttgaccagctcgtcaagtcccggttcgtagatgtggaccttgccctggcgaaggttctcgacgatggtgggattgacgtccacgcagcagacgtcattgcccatctcggcaaaacaggcggcgctcaccagaccaacgtacccggtgcctacgatacaaagattcataaactatatctcgttgttagggttgcccccgccggctcgaagggcgggcggggaacggggctgaagaatatctgcgcatggcggcagggccccgtcatcgaagaaagttgatcgcacttacggattcgtcggacctttgtcaacaattcgcggcccgctccaccccgtttccgtcggttgccacccatttgtaaaacacttacccttccttgacactgtctttaaggagcacgtcatgcccttgcttgcggtcaacgtcgatcatgtggccaccatccgccaggcccggctggccaaaagcccggaccccgtggccgccgccgccctggccgaactcggcggcgcgcgggccatcatcgtgcacctgcgcgaagatcgccgccacatcggcgaccgcgacgtccatgtgctgcgcgagaccatcaaaacccggctgcacctggaaatggccgccaccgaagagatgctcggcattgcgctgaagcgcaaacccgatatggtctgtctggtgccggaaaaacgccaggagctgaccaccgaggggggcctgggcgtggccggccgcgaagccgaactggccgcctacgtggccaagttggccgaggccggcattcccacgagcttatttattgatcccgacccgcgccagatcgaggcgagcaaagccgtgggcgcggcttacgtggaactgcacaccggggccttcgccgacgcggccacgccggccgcccggcaaaaggaactggaccggctgctggccgccatccccctggccaagagccagggccttggcgtcaacctcggccacggcctggactacgacaatatctatgccttcaaggacacgccgggggtcagcgaatattccatcggccacagcatcgtggcccgggccgtgctgaccggcatggtggaggccgtctcgaccatgtgcgccatcatcgacgggtttcccgactagccgctcatgatccgggggcttggcatcgacgtggtggaactcgatcgcatcgaggccgccctgattcgtttcggcgataggtttctggcccgcatcctgacgccggccgaacgggccgccctgcccccgatcccgctcacccgcacggccgggctgttcgccgccaaggaagccgccgccaaggccctgggcacaggctttgctcagggcgtggcctttcataccttggaaattctctccgacgccgccggtcgcccggccctgacgctccacggcccggccctggccagggccgaggcccttggcgcgacgtcctggcacgtgagcatcagccacagccgcgacaccgccgccgccgtggtggtgctcgaaggctgacccggctcccctccccgctttcctctcattacaagcgtgtacgctccctcatggggccggcgcaccgcctgtcgccttgcctctggccgccgtaaaggcctgtttgacggcctcgacttcctggggatgggtgaacatctcataggcggtcagggccacggccgtggcggcctttctcgccgcctgccagccttcgggcgagccggccgcctcccgcatggcgtcggagtgcagggccgtgcccccgggcgcgattttaaaccacacattgaccgtgggataggcgttcccgacccgacccaggtcagaagagacgaactccgtccaatccttgagctgcccggcctcgacgccggccgccaacagcccgcgccgcgtcgcctcgataagcggcgcgacaacaaccggcgaggtcagggccacgcgcggggcgacgaattccagcgaggcccccgtgccgagcgccccggccttggcgcagtcgacaaggcgggcgtaggcgtcgtccatggtggcggtgtccagggcgcgcacggcgaattccgcctgggccagctccggcaccacgttcaccttgtcgccgcccttggtcacgatgccgtgcagccgcacgtcctggggcaagtgctggcgcagcatgtcggcgcagtggaaggtcagctggacggcatttaaggcattgacgcccttttccggcgcggcggcggcatgggaggccttgccgtggaaggtgaacgtagcccgtttcatggccagaaggcgctggtccaggctccagcggtcggccggatgggtgataaggaccacgtccgcgccatcgaaatggccgccttccaggagcgccaccttgccgccgccggccgatccccgttcctcgtcgggggtgcccatgaccaccagccgccccggcagcccgggcatgagcctggccagggcggcggcggccacaagcccgctgccggcaatgagattgtggccgcaggaatggccgttggccagggcgtcgtattcgagcatgatagcgacggttgggccaggggcattgcccgccatctcggccctgaacgccgtttgggacacgcctcccggcacaaggtcggccgggaccgacagatcgccagtgaccgcgaagcccagcccggccagggtctcgcgcagcagggcgctgctttgatgttccgcgccgccctgctccctgagggcaaagatccgatccgccacgtctcggcatgtcggctccacggcggccacgctgtcggtgaccgcatcggcccgaccgactgcggggaaagccagaaccagcccaaccagggccgcaagcagcgcgcccaagagccgcgccgcgccaaagcgtgccttcatgcgctctccttgtagcgaggcccgggagcatggtcgggcggccgccgagccaccgccgggcttccgttcttcccatcccatggccccgggccgtccgggaccacagccgcttaggcgagcagcgacgccgcgtcccgcacgacctcggcaatagccagcccgcgcggacaggccgcctgggccggggagaaatccatggagccaagccccgcgcgcacgctctcgggcaggctggcgaacagctcccgggcgatctcccgctcgccgtagtcgcggtaatacatcatggcccgcatgacgtcggccacaggcacggcgccgcccatggccgcgccgcagatggacgaacacccggcgcagtagtcgccgcaggtggcctcggcgtagcggcgcagggactcgaaatcctcgcgcgccagggccgtgcggtcccgggcggcggccacgttggctccgaggatggtgaggttgggcatttgcgagcagatggaggcgatgtcgggattgttccagaccgctttgagcttggcctgcttgtcggtgaaacccttttccaggaaccggccggccatgtcgagttcggccgggctgtcggatttgaccggcccgccgccctgggtcttcatggccacgaccccgataccggcctttttgcaggcggccagggcctggcgcatcttggcctcgtgcatgaggcggaagttgtaggagatcatgcaggcgtcgatccaatcgaggccggccgcgccctgcagacagtcttccatgttgttgtgggtgctgaagccgaagtttttgatcttaccggcctttttggccttggccgcccagtctttgagctggccgtcgagttcggccggcgacgagatggcgtggatgtagaacagctccacatggtcggtcttgagccgggccagggcggcgtccaggcgttcgtcgaagttgccgcccttgggcgtgagcttggtggtcaggacgatctggctccgcgcttcgggattgcgggcgaaaaaccggccgaagccttcctcggacaggccgttgccgtaggcctcggccgtgtcccagaagttgatgccccagcccagggcctgcttgagcagcagctggttgttgaccgtgtcgaacatgccgccgaggttgaggatcgaaacctccatcccggtcttgcccagggtgcgccggggcatggccgcgccgccggcctcgggcttttcctcggccgccgtggccaccgtcggcagcgcgccaagaccggccacggccagtccacccatgcccagggtcttcatgagctcgcgccgggtcaacccggcctggttgtcttttgccatggaaaacctccttttcaggccaacatgcggccgggaccggaccgcgactcgttttcgctggtgacgcgtatggcccgaaggccggaaaccggacactcgtgttcgcacatgccgcagcccacgcaccgggccgggtccacctgaggctgcatcagatggataagcacctcgacctcgcgcccgggagcggctccgggcagggcggcggccagggccagctcggtcccgccgccgccgaccagccgcaccggggtggcctcgggcgcgccaaggagccgaacgtaatagtcgccgctggccgcattgccggacacggccaagggccgggccagggccagggtcgctccgcgcgcgccagccagggacaaacggccgccacgcaccggctcgaagacctcgcgcacgaagatggccttgggactgaccgggcagacttcctggcagacgatgcacggccggcccatggcccagggcaggcagcgcgtgcgatcgacaaaggccgtgcccaggcggatagggccggcggcggcatagtcgccctggccgagcttttcctgaaggccgagcggccggatggccgccgtggggcagacctggccgcaggcgatgcagtttggctgacaacccgagcggcccaggcggtagttgaggaccggcgtccacagcccgatgagcccggccgtcgtgaccgacggctggatgatgttggacggacaggcccgcatgcactggccgcagcgaatgcagcgggccaggaagcgctcctcgtccagggaaccgggcggccggatgagcaagggcgaacggccaaggccggcggcgtcctccacccgccacagcggcgcgctgaaggctccggccgcgccggcggccaggagcgccaccgccccgcgcctggagaaatcgggcagggccgtttccccggcggccgaagcccggccggcaaagccgatgcgccccgaggggcagcggtccaggcagttgcagcacaacaagcactcgctgacgacaagcgtcccggacggccggcagccgccttcgcagtgggactcgcacaagcggcagtcgccgcagctcttgtccgtggccttgccgatgcgccagggagcgacccgggcggccaaaccgaaaagcgcccccaaggggcagatgaaccggcagaagaaccggggcagcacggcgttcagggccaggatggccagaaaaacgagtccgatccaccacacgccttcgtagtgccggggcgcgtcgtggacgacgcccacgcccgggtcggccagggggagcaaggccagattgacgctgcgaaacgccagcggcaacgggtcgaggagtccggtttgcaggccgcccaaggcggcgcagcccaggaaaaaggccaataaggcgtatttgacggcctgggcgcggccgggatggttgtcctcggcccgatccttggggccaagggtcagccgggccagccagcccgtcatctggttgagcgtccccaggggacagacgaaaccgcagaaaaaccggccgacaaacaacgtcagggccagtacgccaaggccccaaagcaagggcgcgtacagggtgtgcgtggccagcatggtccccagggcggtcagcgggtccaaggacagcagccagttgatgggccagccacgcagctgcaggaagccggcccccaccgtggccacgagacaaaaccagaaaaacaggagcaggaaaaagccttggctgacccggcgggcgacgacgatgcgcatgtccctactccgccgccttgtcgagggtcatcgtcaccggggccagggaggccacgtccatggtgcccaccccggccgcctgggccagggccagatagggcagatcgtccggcgttcgtcccaagagggccacgccgagcgtgtcggcggccacggggtcggcggagaaaatcatcgtattggtggccttgagatcggccagggagccgccggtggggccgttggccatcatggcgctcacgccgtcaagcacgaccagggtcgggcgcaggagctggcccaactcggcgatgacgccgtttatgtcctggtggaagatgtttcgccgcccgcccaggaggccgtagaaatttttgaggctcatggaggccccggcccgctggtggtccttgaccggcgagagcgcgatgaccttggtgacgccggcaaaggctccggccaggaccggccagtccgtgaggagccggccgccgggcagggtcaggggcgaaaacagggccggccgaggcaggaggatggtcgcgccggagcttcgcgccgcgccggccagtcccgagacctcgaaacagctttccgggctattgatgggattgtcggtaacgaccacccgggccgccccggctgcccggcaggcctccacggcggcggcgagcaaatccgggtgggttgtggccccgaggatggccggcgaggcaaaggcggcgttgaccttgagcagcaccacgtcgccccgggagacgaaggcctccataccgcccagggccttgacgccaagatcgaacatggccttgcggtccgcgccgtggaccgtggccagccggggcttgccggggggcggtgcggcggcgcggaaatcgcccagactggccagcaccttgcccccggccatccccgccggccccttgggatcgtagagagccgcgccaaggcccccggcggccacggccaagatcgacgccccggccagccggcgcaagaattgccggcgatcaagcccctggcgcaggtcgggcgcgcctggatcggtaccgccaccggtgacggcgggcttttgcggcaaagtcatggcgtcacgtccttgaggctggccgccagcctggcagtcaattccacggcggcctccaggttgacggcgtcgtggacgccggccaggagccggccttgtgtccagagaatctcaaaggaaccctcggtccccagcaccacggctccggccggcagcttggcctcggccggaggcggcgtggcggcgtagccgttttgcttgaggaaaccggcaaaggcccgggcgtcggcggcggccgcctcggccgtgtcgcgctcggccagaaaggccgtggccggaccggccggcaaggcgtactcggccgtgtagacgttggaaaaaccttccaggcccatagcgtccgaagcggccagccgcacgctgccgggcatcaagccctcgtccggaaacagccccttgacgtctcgggcagccccctgcccggctgcggcggcatcgcccgccggcagggcctcggccagtttctgggccagggcggccagggccggtccggtggccgcctcagcccggtcggccgtcatttccacgtagcggttgcccttggtgaaatagagggcattttccgtggcgtaggcgtccggggagaccgggctgggcctggccccaggccggcgctgggagcttaagacggcaaaggcgtcggtgggcgtggcctgggtgtagacggcgacctccagacgcgtcccatcgggcagcctaaaaggtcgtatagacatttcctgaaaattggcggcgagatacagctcggccttgccgtcgatgcgatcggatagggtttcggggtcatagctttccaccggcccggccggcagggctccgggcaggctctccagccaggcggcgtcggcaaagctccggcccgaagcttgggaagcggctacgcccggcggagggggcggactcagcgccaccaacacggcggggttcaggcgcgattgggccagccccagccagacgacgatggcggtaaggaccgtcaacacgccccaggccgtcctgcgctcctgccgcgaaacatgtttgcgtcttgccgccatggctgctccgtccgagatccgctggcggccctttcctgggacgccctgggtacgaaatgcctgacgcgccgccgcgcgtcacgctgccgccgtttgcatcatgaggccggggctaccgggccaccggctcccccttggagcagtcgtaacgcggggggcaggccgttgcggttgccagcagttcctggggcgacgtggcgtcgagttcgccgtttcgcagcacgaaccgcatctcgccggccacgggaaaaccgtcggcaatggccttttccagacgcttgaccgcgacggcgtattccggctcggccttgttcttgtggaattggcgtcgccattcgatccactgcttgggattcatggcgctctggtcgaggaagacgaaatcggtcaggccgtccgagcaatcctgctccaggtagagcgtgtactcgaagaccgggttggccggatcgcgcttgtcgagccgctccttctcgctgtcctcgatgagccaggaggtcttgcaggaacgactggccgcgaactccccgaccggtccgaagagaaaggccggccggccttcgtcggcaatgaaaaagccgtcgagaaaggccttgggcggcgcataggggatcagtcccagggattggcgcagattcgcggcccgcggactttgggccgtggccgggcaagtgccaaagagcagtgtgaaaaccatcgccgtggccgcaaaagacgggaaaaaccgctgcatggcgcacccccacggtcgtgaaagggaaaccgaggatgcctgccaactaccaaccctgcccggcgaaggcaagccttgtggccaagggcctcgaccaaacgggccgcctgcgccctggccggatcagttgatcctgaaccggatggtgagcgtcgcccggctggccacggtctgtccaccccgcttggccggggaaaaagacgaagcgcgaacggccttgaccgcctcttccgcgaattccaggccgctgtgctccagcacctcgacgttacgcagcccgccggcggcatcaatgaaaagccgcagcgacaccttgccctccaggttggcccgcttggcttcgctgggatagctcggcaacgaccggcgtcggaagcacggcccgtcgccctggccgaattggccgacgaaatcgccgccgccgcccccgcccggcccgtcgccgctcaaaccgccatgacccggaccatgccccgacccatggccctcgccggggccggccggtcccgtgccggacggtcccggagaggcctcggccacagacggcccggcgacggccgccgacgcaacggtcttggccgtcgtcggcttgtcctggggacgcagagccttggccggaggctggactggcggcttggcctggggcttgggcttgggaggcggctggggttggggctgcggccggagttcgggcgacttgggggcttcagggtccggcagcagcacggtttcgggcgaagcaaggggcttctcctcaagaaccggcgcggcgtccggcggcatagtctctgccgccgaccccatgtctgccgcctgggcgaccatcggcaggacaggacctgctacccgcccagcaacgggcaacccgtcgccgccgccaggcagccgaccatccccgcccgcgccagccggaccggccaggccggccagatcaatctccaccaccggttcggccacgggcaaattttgggacaagtccagcaggccggcccagaccaagccgataacagccaggctgtgcagggcgcaggaaatcgccgcgcacagccacggccgggccttgccggaccgagccggaacagccgtgtccaggcagcgggccagagcggccaggctggcgtcgtgctgcgcttcctcgtcggccatcatcgtcatgtcaggccacgctcccttccatgaatccggctcgcggatcgcccccggtcaggaaaaccgggacgcgacagcaccgtcaacgtcgcgaggctggctcgaattccggaattcatcctgtttcatgaacaatttcgggctgcatcctccgccagttttcttcacccatggcaccccgtcagccacaaacaatctccaaacaaaaatttttcgacgcaacaacaggcactttcaggcaacataaggattcatacaagcatgatcaatgcttcaatcggaaatttaacaggtaaaagacaaaataaccctcaacgatcacgcttcacaaaattatcgtgaaccattgcttttattaaatttattacatacatccggccaaagccaagcatcgccgacagcttcgtacaacggagacacaacgaagcgcttatgctgattccgttttaaatatcaactgtcatgtgaatagaattattcgtgacagtcaaagttacttagcggatgccgacaacgagaggggccgcctcggcggcaggttctggcgtcgtcgatcacccggcacaaggccgggagcgcaagcgggcaggcaaacggggaaagccgccaaccggacaaagggaacacgcctcgcctggcggcgaggccactgcgacggacagcggccgaacaggcgtgcggcttgcgcggggagcgtcgcgctcgacggcgggcgcgccacggcgactgtcgcggcaaggagtgggaacggcatccgacacagatgggtctcgcggaggagttgtatgaagcgtctggttattgcgtcgttggcgttatgctgcgcccttgcgccatccctggccccggcccagaccgatcccggggaaatggccgccaacatggaggaagtggtggtcacggccacccgcaccgaacagcccatgaaggacgtgcccggccgggtggccatcatcacccgccaggaactcaaggacctgcccatccagaccgtggatgaggccctgtcctacatttccggcgtccacgtggagcggccaagcggcatctacagcttcaagtcggtggtgtccctgcgcgggcttggcaacgagcagggccgtaccctggtcctcatcgacggcgtgccgcaaaacacctcggacatgggcgacgtcaactggaaccgcatcaacctcgaagacgtcaagcgcatcgagatcctcaaaggcccggccgcctccatctacggcaacaacgccatgggcggcgtcatcaatatcatcaccgaaaaaccgaccaaggtcgtttccggcatggcctccaccagctacggcacatatgacgactggaagctgcggggcgtgctggccgggcggacctccgaggaacccacggcgctctatgcccgcgtttcgggcctctaccacacctcgcccggctacatggccacccccagcgacgaacagaccccctggtccgtcaaggagttcatccgggaaggcaccgtcaacgccaagctcggctgggacatcaacgccaacaacaacctggaattccagtacaccaacgacagccagcgggccggcgaaggcacgaaatacttcgcctccgacggcgtgcaccgcgaatacgacaccgacgcctggcaggggaaattcaccggctcctgggaaggctggtcggccgtggtcaacgcctacttcaccgacatcaattacacccgcgtcaacgaatcctggtccgacgtcaccgacatctccaagtacacccgctacgacgccaaggtgaaccgcaagcagtacggcctgctctccaacgtctccaaggaatgggccttcaacaccttcacggccggcttcgactacagcctgggcattatggacggcacggactactaccgcaccaacaccaacttcgccaccgactacggcaagatccgcagctacggcgtctttttccaggaccagctcaagttcctcgacgacaagctcatcttcctggccggcctgcgctacgacaacgccaccaccttcgatggccactacgacaccaacatctcaagcttaagcaagtacaccgagtactacccggaccataactgggacgactggagcccccgggcctcggccaagtacttcttcatggacaatttaagcgcctacctgtcctacggccacgccttccgcgccccgcttctggacgacatgtaccgcaccggcaagatgaagggcggttccaagatctccaacccgtcgctggggccggaaaagctcgactccttcgaagtcggctcggactacgcgcccttggagaacctgcgcttctcgggttcgggctacttttcggtgggccgcgacttccagtcctacgtcaccgtggcctcgggcatcatgcaaaagcagaacatcggccaggtgcagatctggggcgcggagcttaatggcgagtatgatccgttcaagttctcgggcttcgacgtcatgaagaagttcacgcttttcgccaactacaccttcaatgactcccgggtggcggacttcccgggccggcccgatctcgtcggcaagcttttgccctatgtgccgcaaaattcgttcaacgtcggcttcacctggctcaacaagtatctcaacagcaagttcggcgtgcagtacgtggggctcatgtacggcgacgacgtcaacaccgacgccaacatcatcccgccccacgccctggtcaacgccaaggtctggcgcaacctggacttcatgggaacctacggcgagaagctgacggtctcgctgaccggcgaaaatctcctcgaccaccagtactacaccgcccataaccccaattccgtcaacaccgggcgggcgctttacctggaaatgtcatgcaagttctagccgaccgccggccggggctgtccaccgcccaggtggtgttcttcgcctccatggtggccctggacttcggctggggcatggttttcaagaccgcgctgcagctcacggccattcacgaggtggcccggctggaaatgctcgtctcgatcatgctcatgacgctcacccggctcatgatcgaccgcttcggcacgctcattgccttcgaactggcctgggggctgctggccgccgcgttcatgccggcggccggcggccagccgggcgtcatgaagctcgtgccggccctgatccagggggtggtgttcgacacgcttttcacgctgctgcgcgcgtccctgccccaggcccgggcctatgtcgccgtcatctgcggcggcctgctcggccccacggcggccatgggcgttcgcgtggccctgggcgtgccgtgggccacggccaccaaggccctgttcggcatctcgctggtcacgtccgtcttcatcaacggctttggcgtctacctggcccttaccgtgtggcgacgcatcaaggacctccacgtcgtggccatgctgcgccagtcatgattgaactggacgacgtctccttcgtgcctgccggcgcgacctgccccaccctggcccatgcaaccctccgcatcggccagggagagcgggtgggcatcgtcggcccgtcgggttcgggcaaatccaccctcggctaccatctgtgcggggcgcacaggctggccctggccgggcgcaccgacggccggctggcctttgccggacgcgacggaaccgacggcgcgccggtgggtttcgccgggctggtggggcagaaccccgaagcccagctgttttgccgcaccgtctacgacgagctggccctggccttgctcgcccggggcgaggacgaggcctgctgccggcaaaccgccgcgacgctccttggccaatacggcttcgccgagcgtggcgaagcctccctgggcagtctgtccctgggccagaaacaattgaccgccgtcctgtccatgctggccatggaaccgcgcgtgctgctcctggacgaacccaccaactacctcgacgccgccgccgccgaccggctttttgcccatctgacggaactgagccgggaactcggctggatcatcctggtcatcgaacacgaccggaaacggctggccggtttcgccgaccggctcatcgccctggacagcggccgcatcgtccatgacggcccggcgagcgactgggaagcctggaacgacgaggccggcgaccgggacgaaaccctggccgccctgccgcctttttcacttgcctcgccggacgccgcgcctttggtcgcattgcagggcgtgggtttcagctactctccgaccgcgccggtccttcgcggcctggacctggccgtgcgcccgggtgaggtcgtggccctgctcggggccaacggggccggcaagtccacggtgctgcggcttataaagggcctgggcaagccggccgtcgggcgggtcgccctgggggcgggactgacggccgctagcgacgtggggctgatgttccaaaatcccgaggaacagcttttcgcccacactgtggccgccgaatgcggctactggctggaaaatcgcggtgtcgcgcccgaagaacggctggctcgctgccgcgccgccctggccggcttcggccttgacgcaatgctttcgcgcgcgcccttttccttgagcttcggggaaaagcgccgcctgtgtctggccgccatcctcgtggccgagccggccgtgttgtgcctggacgaaccgaccacgggcctggacgcggccaacatggcggccatggccgccgaggtccgcaggcaagcggcaaagggccgggccgtgctcctggccacccacgaggaagccttcgcggccatggccgccacgcgctgggtcaccgtggccaacggccggatcgcctcggaccggccaaacccctggctggccccatgacggccgtccttcgccgggcaagcgccctgtccaagtgcgcctttgccgtgtccctttccgtctacgcctttgcctgcccggactggcgcatcctggtcggcgtcaacctgctcctggccggcctgcttgtcgcctcgcggcagttcgaccgcatcgtctggctggctcttggcgtatgcgtcgcctccctgccgaccctgggcgtgctgttcctgctgggcggggtggaaaaggccgccacttggcgcgaaggccttgttctggggctttcctggctggccgttttcgagctgcgcctgctcgtcatgctcctggccgacatcctggtcgtcaagtggacgacgttttccgacctgctcctgtccttgcgggcgttgcggctgccgggaaagctggtgctcttctgctcggccctggtcacgctgttgccaagcgtgttctccctggccgcccatgtggtcgaggtccagcgctgccgggggtttgaccccaaacggctgcgcaatcccaagaattttttgccgctgttcatcccggttttcctggcccagttgcgccgttccacggacctggccttgtccctggagcttcgcggcatttccggcgcgccgccggccagggcctcgcgcctgacgctcggggccggcgacgccgtgctgctggcggcggcggttgccgtctggctgctgccgttcggtgcttgacgccaacgaaaccgaagcggaaacagcaatgatcgcctcgccaaggagttcccatgatccgttgcgatgtctgtgagcggcgctgtccgctgggaccggacacctccggctattgccgcatgtaccatgccccgcacggcctggtggaggaacgctttcccgaccgctggtgcgcctacgccacggcccgcatggagaccattcccttctaccacgcctggcccggagcgcgttgtctggtggtcggcacggccggctgcaatttcgactgccgctattgcgccaacgccgaggtggtcaaggtcgatccggccggacagcaggacgtcatgctcgacattttgccggaagatctcgtggccgtggcccgaaagcgcggctgccgggccatcgtcttttccgtcaacgagcccaccgtctccctgcccaccctggagcgggtgagcgttgccgcccgccgggccggcctggtcatgggctgcctgaccaacggctacgccacgccagaggggacggcgcgccttggcgcgatattcgactgcgtcaacgtgagcctcaagggcctgtcgcccgagttctgccgggactatctcggcgttcccgacgtggggccgatcctgcgtaacatccaggctctggcccggaccacccacgtggaggtgaccaccccggtcatcgagggcataaacagccacgaacttagcgagatggtcgacttcctggccggggtcgggccggacgttccctggcacgccttccggctgctgccggaatacaagatgcgccaggaggactacccgagcgtggcggccgtgggcgcccaggtcgaggcggccgcccggggcaagctgcgctacgtgtatttccacaatttcatcggctcgcgctgggtcaacaccctgtgtccgggttgcggcgaggccgtcatcgaacgccacagcctgggctgcggcggcgaccggctccaggccgtgcatctggacggcggggcctgcccgcgctgcggcgcatccgtcgccctgcgcggcgaccccgatccggcaaccgccaaggaggcgtgctcatgagcctggccatcctcgacgcccgcgagtggcagcaaaccgttgatctgcgcaccggccggcccagggaagcaaccggccccctgaccgacatggtcgccggcgtcgtcggccgccggccctatcccggcgaccgcgacgcggcctgcaacgactgggtggccgacgtcgccctggaattcgtcgagcgctacgatccccggttcgcgtttcttagtttctccgaacaatactattccctgcgccattcgcccttgaccaaggccgaggagcaggcccgcatcgacggggctttcgccgccgtggagcgtttcgcccgggagtcgggctttatcgtggtcctggtcggcacgggcgaactcgtgcccgccgccgtgcccgtggacctggaaggcctggacggcctggccgtctccagcaactggtgcgcccattacgccggcctctacgacgcctcggccggggacctcgacaagctggccaaccatccggccatcgcccatgtggcctccaaggccgacatcctgtccctgttcgacggcgcggccgccgacggcgagcgtctgccggaacacatggtcgcggtcaaggagggccactacttgaagggcacgtccctgcgccgcctctacaagattccccagcccagcccgatcatccccgtcagcaacaacctcgggccggtggcctgcctgaccgacatccgcccggccttgctcaagctgctgcgtaccgacaaggtggccctggcccttatcgaaggcgtgggctgccgccagtttcccctgccccaccaggcctgcgccaacggccggggctggttcgcctacgaacccggcgacggccagttcctggccataagcaaagggaagcacagcctcttcgagcacaacggcggctaccgctactaccaggacgacaccgacgacaaagcctatccctactccggctttttcagcgaaatgcccaccggaaccatcggcgaggccattgccgcgcgcagcattgccgtgggcaaccgcagcatgttcatgcacatgctgtccggctgcgacatcacctgcgaatgctttgcccgcaacctctacaaccagggcgtcatggccgtgatccaccgccaggacaagttcgccgggaagtaacggcgatgcccatggagaagaccggcgacgccgaggggtttgcggccatcagccgggagatcttcgccccgctctatccctattacgccgcccggttcctggccgcctcgggaatacgccgagggctttgcctggacgccggggccggaggcggcctgctcggcctggccgtggccgaggccagcgcctgccgggtgatcctggccgaccgctctgtggccatgctccgggcggcgcggcaggaaatcgccgcgcgcggcttgcctggccgggcaacggtccttggggccgacgtcacggccctccccctggccgagggctgcgtcgatctggtggtcagccggggttcggtcatgttctgggacgatctgcctcgatcctttggcgaaatatggcgggtgctggccccggacggccgggcctatatcggcgggggccttgggccgccggccatgcggcgggccatctgccgcgagatggccgcccgcgatccccgctggcgcgaggacgccccgccgccgccccggccgggcaccgaccccgacacccaggcggccgccttgcgggccgccggcatccacgacttcgccatcgaacccgacgacgccggccactggatcgttttcgggaagtagaacgggtccagccccgttgttgcgcaccccaaccccgcgtttcagctgacaaaacggattttccgccgcgcactgcatcccggcgcgcctcccaggcgaatccttgataaatgcccagccccgtttcggtcgcgacacgcgcctcgtttcgtccgagaaacgccttccgggctttttgggtcgccgccgggcgatggccagacggaccgatcctgcacccatcaccccgccgtttgctttcccgcccagacttttttttcggaacagatgtggaaacaacaaacagatgatccgatcgtttgcaaatttgtcaaaacaggcgtcagcaacgacaatcgcccgccagcagcaacaatcccaactcccaggagaaacctttgcccgttagtgtcggcattgacagcgaccagggacaacgcttttgtggggatcttctgtcgttttttcgaagccctattgacgcacccgcataacaattgtactcattggtcaccaaaagttcacacgccaaacccggcccaggaccctcggagcctgccatgaccaccccagacgacagcgaacaccagctcatctcccgggtcgcctggctgtacttcaaggaagagctcacccaggccgaaatcggcgaccgcctcggcatcacccgcatcaaggtcaaccgcctgctccaggccggccgcgaagccgggctcatccgcgtcgtcatcaacaccgccttcaaggactgcgtcgccctcgaagccgggctggccaaggaatacggactggcccgggccattgtcctgcccactcccgaacgcggcggacgctactattacgacgccatcggccgcccggccggcgaatacgcctcgctccagcttcaggacggccagtccatcggcgtgggctggggccacaccatccgctcggccataaacggcatggccgtgcgcaactttcgcgacatctccgtcacctccctctacggcggcgtgccccgaagtccggtcaaccccttcgactccacggccatgttcgcccgaaagctctcggccgccgtgtgcaaccacctgcccgcccccatgttcgtttccaccccggaagtgcgcgacaccatcgccgcccagcccttcttccgcaccttttataaggaagccctggccgtggacatgatcctgaccgccgtcggcgacatgaccgcccaggccaccaacatcgccctgggggccatcagcctcgaccagcgccgcgagctggcccgggccggagccgtgggcgaatttttcggccgcttcctcgacgccgagggcaacgtcctcgaccacgaggtcaaccattgcagcatgtcgccggatttcggcggcctgctcaaggtcccgcacatcgtcctcgtgtccggaggcatggccaaggtcccgatcctccaaaccatcctgcgccggggctacgtccacgtctgcgtcaccgacgcccagacggcgcaaagccttctcgacgcgtaacaaggcggtatcatgaacagacaagacaacatcaatcagctgcgcgctggcgaccccttcgatctggtcgtcatcggcggcggggccaccggctgcggcatcgccctggacgccgccacacgtggcctgagcgtggccctgctggaacgcgacgatttcgcccagggcactagcagcaaaagcaccaagctcgtccacggcggcgtgcgctacctcgaaaaggccgtcaagaagctcgacagagcccagttcgatctggtgcgcgaaggccttcgcgagcgtggccggctgctcaaaaacgcaccccacctggcccactccatccggctcatgaccccggtcaagacctggcgcgaggccgcctacatctacgcgggactcgtgctctacgacatgctctccggctgcctgtcgctgggccgcagcgccgtcgtcagcaagaaaaaggccgccaagctcttcccccagctcaacctcgacggctacgtggccgccgtcatctacagcgacggccagttcaacgacgcccgcatggccgtgacgctggcccgcacggccgcctcctacggcgcggtctgcgccaaccatgtcgaggtcactggcctggtcaagcagggcggccgcatctcgggcgttaccgtgcgcgattgcctggacggccaggaattcactatcgccgccaagggcgtggtcaacgccgccggcccctttgccgacgccatccgccgcatggacgaccccgaagtcgcccccatgctcaagaccagctccggcatccacatcctgctgcccgccgacgtcgccccccgtgacctgtcgctcatgatccccaagacggaagacggccgcgtgctcttcatgatcccctggcaggggttcgtgctgttcggcaccaccgacgagcccgcgcccatcgaattcgatccggctcccgaacgccgcgacgtcgattatctgctgcgctacgccagcgcctacctgcgccggcccgtcacccgcgacgacgtgctggccgtgtggagcggcctgcggcccctggtctttaatcccaacaagaaaaacacccaggaactggcccgttcccacgtcatcgacatcagcgcctcgggactcctcaccatgaccggcggcaaatggacgagttaccgcagcatggccgaggaagccgtggacgccgcttgccagacgttttgcctcggccagtcgcgcccctgcgccacccaggaactgcgcctgctcggctcccgggcctatctgcccgagggctggcgcgatctggcccgccgcgaaggcgtggccgacgagctggcccgctccctgtggacgctttacggcgacgaagccgccgccatcgtcaaactgggccgcgacgaggatctgttgaccccgctgcatcccgaacacccctacgtcggcgcggaagtggcttttgccgtgcgccacgaaatggcccaacacgtgggcgacgtgctcctgcgccgcctgccgcttgggctgctcaacatgcgccacgccatgcaggccgctgcggccgtggccgacatcatggcccgcgaactcggctgggacgaggcgcggcgtgacagcgaagtggataacgcctgccggctgcttgccgcctggttcgccgggcgggaggaccaggccgccgcacaggcctagaacggctagggaaggtctgggttcaaccgccgcgtcccgtcccgccaggagggcagcggccaacgacgcaaatggaggaggggttacatgagcaacgagtcgtcactgggcagggaaatgctgtccgaattcatggggaccatggttctcatcctgttcggcgcaggctgcgtggccatgaaagtctttttcggggacgcgctgaccgtcacttggaacaccattacccttggctggagcatgggcgtcctttttggcgtcctggccagcttgcggtccggagcccacatcaacccggccgtgagcctggccctggccgtcaccggccgcttcccctggaagaaagtgctgccctactccctggcccagaccgccggcggctttgccggagcagccctggttttcaccgatttccacgccaaatggctcatgtttgacccgcagctggtcaagaccgccggcatcttctgcaccttcccggccgtgccgggcttcatgccgggcttcatcgaccagatcatcggcaccgccatcctgctcttcggcgtcctggccatcggcgacttcgccgccaagaacaaaaacggctggctcggccccatcgccgtggccatgctcgtcatgggcatcggcatgagctttggcgccatgaacggatacgccatcaaccccgcccgcgacttcggcccccgcttcttcgccctggtggccggcttcacccagcccaacctcatggacgtgagcatcgtgctggtgcccatcgtcggcccgctcatcggcggcccgctcggcgcgctgatctacgacaagaccaccggttcgctcaacaaggatctcgaagcctaggaggcgtacacccatggccaattacattctctccctcgaccagggcaccaccagctcccgcgctatcctgttcacccgcgaaggcgacatcaaacagatcgcccagaaagagttcacccagatctacccccagccgggctgggtcgagcacaacgccaacgagatcttcgacacccagtcctacgtcatgcgcgaatgcctgcagttcgccggcgtggacgcctcggacgtggccgccatcggcatcaccaaccagcgtgaaaccacggtcgtctgggacaagaaaaccggcgcacccatccacaacgccatcgtctggcaggaccgccgcaccgccggcttctgcgacgaactcaaggccaagggcctggccgacgtcatccgccagaaaacgggcctcgtcatcgacgcctacttctccggcaccaaggtccgctggattctcgacaacgtgcccggcgcccgggaaaaggccgacaagggcgaactgctcttcggcaccatcgactcctggctcatctggaacctgaccaagggcgcggtccacgtcaccgacgagtccaacgccagccgcaccctgctttttaacatcaacaccggagcctgggacgacgagctgctggccatcatcggcgtgccagccgccatgctgccccgggtgtccaagtcctcggaagtggtgggcgaaatccaccccgaattcctgggcaaagccctgcccatcgccggcaacgccggcgaccagcaggccgccacctacggcaacgcctgcctcaaggaaggcatggccaagaacacctacggcaccggctgcttcatgctcatgaacaccggcaaggccccccgccccagcaacaacaacctgctgaccaccatggcctgggccaccccgtccggccgctacttcgccctggaaggcagcgtctttatcgccggcgccgtggtccagtggctgcgcgacggcctgggcatcatccaaagcgccccggaagtcgaacagctggccctgtccgtgcccgacaacggtggcgtcttcctcgtgccggccttcgccggcctgggcgcgccccactgggaccagtacgcccgcggggccatggtcggcatcacccgaggcgccaccaaggcccacatcgcccgggccgccctggagtccattgccctgcagacccttgacatcatggactgcatgcaaaaagacgccggcatcaagctcgacaccctgcgcgccgatggcggggccacccgcaacaacctgctcatgcagttccaggccgacgtgctgggcgtgcccgtcgagcgccccatggtgaccgaaaccacggccctgggcgcggcctacctggccggcctggccgtcgggttctggaagagcgaagaagagatcgccgccatgtggcagctcgaccgccgctttgaacccaacatggcccagtccgaccgcgacaagctcctccacgactggcagcgcgccgtggcccgcagcaaggcctggatcgaagcctagtcccggacgttccagcacccgacgccaaggggcgcgaccacgcggtcgcgcccctttttttgggcttgcgaaacggcgctgattctgctcccatccgtctcgacatgatctccacttcttgccccgccacagcctgaggcaacctatgatgacccgtcacgacgctcgcgaagatttgtcccggctcgaccatccctcgcggcttttcgtcgaggtgacctcgcgctgcaacctgcgctgcgccatgtgcgtcaagcattccggccacggcgtccaggccgagggcgacatgtcgccggaaacgtttcgcgccctggaaccggcgttcccccacctcgacgccctggtcctcaacggcatcggcgaaccgctgctccacccccgcctggaggccttcatccagaccgccaaacaggccatgccgtccaccggctgggtcgggtttcagaccaacggccatctcctgacccgggcccgggccacgtcgcttttcgccgccggcttggacaggatctttctttccgtggacgccgcttcccaggaacttttccaagccgtccgggccggcgggagcctgggccacgtggaacgcgccctggccgccttggctgaagcccgaaaggaccatccggggcacaaactggaagtcggcgcggagttcgtggtcatgcgggacaatctggccgaactgccgggccttgtctcctggctggccgcccggggcgcaaccaccctggtcgtgtcccacttgctgccgtttagcgccgccctggtcacccagccggtctttggcgtcaatacgcgtcgggccaaggcgtactaccaggagtgccaggacagggcgaaagcccaagggcttgccctggaccagtacttccggatcgtctggaagtaccacaagaccccgcaagaacaggccctcgccgatttcgtccagcaaatgctctttgacgccgtgaaacaggatatccccttccaggtgaccaacatcatcacgggcgaggatcttgccctggtggaggacgtcttccggcgagcggaaaccgtcgccgaaagccacggcctcaggcttgtcctgccgccggtccagccggtcagcggccatgcctgcctgggcgtcaagaaaggcggaatgttcgtggcctgggacggcaaggtttcgccctgccatttcctgtggcgcagcttttcgtgttatttctatggccgggagaagcaggtcgcccacaaggtgttcggtgatatgaccaggcagtcccttgccgccgtctggaacagcccggcctatcgggcctttcgcgaggacgtgatgcgccggcgctacccccattgcccgagctgcaacgtctatccctgcgaggacatcaacagcctcgattttgaaaacgattgctacggcgagaccgtcccttgcggcgactgcctctggagcatggggcttttgcagtgcatgggacaggaagaccttgccggcgaattccaagaagacgcctcgggcgcaagcgaagtcccgccctggggcctgttccggctcgggggacaacgccgcacccagatcccctcctgacagcaagcggcaggcccatcgtttgacctgccgcccatcatccccgccgtcgagccctcgtcagcccaagagcccaaagcacacgcgcttggacgcgtcacggacgatttccgctcgaaacgaccggagccgtagacggctgacggccattccccggggggtcagcccagggcgcgctccacgatggccgtcagctcggccgtggtcagattaatgggattaccctgcatgctgctggcccgtgccgccttttccaccaccaagggaatgtcggcctgggtcaagcccagagcggtcaacgtcggcgcgcccaggcggcggcacaacgcttccagccagaccgccccgtcctcgggcgaagcatccgcccggccggtcagcatggccgccgccgcggcataggcggccagccgccccgaacccggctcccgctgccgcagcgcggcgatgttgaccgccgccaccgccggcaacaagctggcgcagacctgcccatgaggcgcggcgaaaagcccgcctatgggcgcggcaaacccatgcaccgccccgagcttggcgttggccagggccaggccgccgtacaggctggccagggccatgccctcccgggcggccatgtccgccccgtcgtcgtaggcggcggccagatagcgcgcggccagacgcaaaccgtcgcggcacagggcgtcggtcatggggttggccttgatggaaacaaaggactccagcagttgggtcagtgcatccaggcccgtggcggcggtcacggccggcggcatggagaccgtcagctcgggatcgaccaacgccacggtgggcagcatcatgaccgagcgcaggctcaccttcacccgctcggccggggcggtcagcacggcgttggccgtggcctcggccccggtgccggccgtggtcggcacggccacatggggcaagggccgctcgacaaggggccgcccggcccccaccacttccagataatcatacggatcgccgggattggtcgccagggccgccacggccttaccggcgtcgatggctccgccgccgccgacgctgacgaccacgtcgcaaccggcctcccggcacaaggcgacgccggccttggccacgtccaccgacggttcgccggctacggaaaagagcgtcaccccaaggccggcggccgcaaacgcctggatcagcccggcatggcggccgggactggcccccacgaccagcaaaacgtgtttgcccaagggtgcgacaagggacggcaggcgcgcggcctggccgggaccgaaaacaatcttggccggtgcggcgaattcgaagttcatggctccactatggctccagcccttcccccaggcaaccccctgcccgcaaaaaaagaaccccccgtccgggttgagcggggggttccaagggagcccgggagggtaaccgggcaaaacttcggcgcggctcgcggcagggtgctccccgcgccgaagacggcagcatgatgcgaagcagaagcagaagaggaagatgcctccggcggccggggggaatcattccccccggaccccctgaattgttatagagggtgcggcgttaccgctgcggccagcagaagggaacgttcggttgcctgtccgaatattcgcctctggcccagcgtggcttagctgctattcctcctcggcctggcgcttgaggcgggccatgaggtcgatgcgaaactccttgcgatccagggccaccatgtacggattgtcggaaaaccgcagcgaatccaccgggcaggtcttggcgcattggccgcacaggctgcacagggaaaaatccacgatcaccgcgccgggcgtcttgctgcccttttgcggagccggccccatggccatcggcgcgtcttcctggccctccttggccggaaccggacacagtatggtcaggcaatccgacggacaggccttgacgcaggccccgcaagccacgcagcgcggcacggacgggtcgtcttccttgcccacgagttcgacatggccccggaaggtcgacaggttgtccacctcttgcttgggatagatcaccgtcacctggggctggcagaaggccttgcccgtgatgccaaggcccacaaacaggctcttgaggccggtacaggcttcctcgaacagttcactcaccgacatgtcagcctccgatgcccttgatgatgaccaccagcgccagatcgatgatcgccagcggcgtgagccacttccagctcagattgagcagctggtcgaaacgcacgcggggataggtccagcgcatccagatcatgagcagcaaaatggcgtagaccttgaccagaaaccacaggatgccggacaaaaacggcccctgccagccgccgagaaagagcgcggcggcaacgccggaaaccacgatcatgttggcgtattccgccaggaagaacaggccaaagcccatgccggaatattccgtgtggaaaccggccgtcagctcggattcggcctcgggcaaatcgaagggcgcgcggttggtctcggccacggcgcagaccaggaagatgaaaaaggccaacgggttctgcacgccgtaccactgccagggccagccgccctgcttgcccgtgatctcgtagagatccagcgacccggcggtgatggcgacagacatgacggccagaagcagcggcacttcgtaggccacggactgggccacggcccgggccgcgccaagcaggccccatttgttgttggagccccagccggccaggatcagcgacagcacgcccaggcccgagaaggccaggatcagcaccaggccgatgttcaggcgcatgggcgcgaggtcggggtcaaagggcagcggcagaaagcacaccgtcaccggggcgaaggccagaagcggcgcggcccagtagaggtacttgtccgcgccggccggcatagccagctgcttgcccaccagtttgaccgcgtccacgatgggctggagcaggccgtaggggccaacatgcagggggccgggccgcaactgcacatggccggccaccttgcgctccacccagacgaggacgaggccgtttaagcccacgaaggcgaacacgcacaacaacccgacgacgagacgcgtcaggggatggtcgaagcttaaaaggtcggggctcatcggtcgatctccgggatgacgaggtccagactgcccaggatggacacggcgtcggccagaagggttcccctggccagctcgcagaagacgctcaggttggagaagcccggggcgcgcagcttcacgcgatacggcttggggccgccgtcggagcgcacgtggacgaggattttgccgcgcgcgccttccacggcgtagcaggcctcgcccttggggggcttcagggtcttgggggccttggccgaacagggaccgtccggcagctcggaaacggcttggtcgatgatgtcgcaactggtttccagctcgtccatgcgcaccatgtaccgggccatggcatcgccctggctgtaggccgggatgcggaagtcgaacttgccgtagacgctgtagggttcggcccggcgggtgtccacgggcgcgcccgagccccggatgaccggtcccgtggccccgtagcggcgggccagatccacatccatctcgccgatgccttcgcagcgtccgcgcaggatcacgttgtccgtgaccagatcgcggtacatgggcagccgcgagcgcagatgcttggtgaaggccaggcagcgcggggcgaagtcgcccggcacgtcgttgtagacgccgccgaaggtaaagtaggaataggtcaggcgcgagccggtgacggcctgcaggatgtccagaaggatttcccggtcatcgaaggcgtacatgatgggggtaaacgccccgaggtcaagcagataagccccccaccagagcaggtgggagctgatgcggttgagttcggtgacggccacgcggatatgttcgccgcgctcgggcacctcgatgccggccaggcgttccacggccccggcgtaggcccagttccaggccatggcgtggaggtagtccacccgacccatgttgggcatgaactggaagtaggtcttttgttcagccatccactcgtgcatccggtgaatgtagccaagcacgggttcggcccgcacgatgtactcgccgtcgagttcgagcaggatgcgcagcacgccgtgggtggacgggtgctggggtcccatgctcaaaataagcttgtcttcggtgggacccggctcgaagcgcaccgacgaggggtcgcgcggcaattgggcggtgtcaaaagcttgcatgaatcctccgcgccttaggcgtcttcggtcttggccggtttgacggccttgacggcggcgggtttgggcttttccgcctcgggttcggccaggccgcagtccacgaggtagccaaggggcatcaggtcggccagggacttgcgggccttgtcggccttgaccagcggatgtccctcgaagtcctcgggcaacagcagatagtgcaggttggggtggccctcgaagcgaatgccgtagaaatcgaagcattcgcgctcgtgccagtccgcgcccggatacaccgcgctgatggtcggcaggcttggggcgtcgtgggggatcatggcccgcaccacgaggcggttggccccgtccagcaggctcaagtggtaggtgatctcaaagccgtcctggagatcggaagccatgacgtcttcgagcagatagccttcggcgtcgaggacttccatggcttccaccaccttggcggcctccacggtgacggacaaggtcatgccggttttggcatggtccatgggcgcggaacacaccggccccatcttggcgacaaaggccgggatcatgactggcctccctggggaacctgccaccaacgccgtccggtcatcttctcctggatggcgaaaaggccttccagcagcgcctcgggacggggcgggcagccgggcacgtacacgtccaccgggatgagcgtatccacgccctggatgacgttgtactggttttcgatgttaaacgggccgcccgagatggcgcagttgcccagggccatgacgtagcgcggggccggcatctgctcgtagagccgcaccacggccggggccatcttcttgttgaccgtgccggccacgatcataaggtcggactggcgcggcgagggacggaagacttccgcgccgtagcgggcgatatcgaagcgggccatgcccacggccatcatttcaatggcgcagcaggccaggccaaaggtcatgggccagatggacatggcccggcacacgtccaccagcttctggaccgccggctgggcgatcagggccgggtcgaccgtatttacggccggggcgagacttggattttgcggggccatgtgaacactcccttgcgcatgaagtagacgacggcggcggccagcaccgccagaaacaccaacagtttaaacgtcgtggccagtccctggggcgaggcgtaggccgccgccaccgggaagaggtagaggatgtccacctcgaaggccaagaagatcagggcgtagaagtagtaattgatgccgaacttgatccaagagttgccgtgggtgggcacgccgcactcgtaggattcgcccatggccccgccatgcgcctttggggcgatgagcagcgagccgaccaacgggcctgcggcaaataggacgccgcccaggaaaaagagcagtatcgccgcttgcagccaagtgaaaaccatgcgtcctctcctcctttcgaagttgcggtaaccgtgtctctaggcgttgggacgcacggttacggatgcagctggccggccgcctgggcggccagatcgtacaggggcgcgggcaggatgccgagcagcagcaccagcacggccaaggccccgccaaagatcaggtagccgcgcggccagacgatggccggcgcgtcggattcaccggtgtaggcatggcgcaccatgctcaggtagtagtagatggagatggccgtattgagcacggccacgatgaccagccagtggtagccctggtcccaggcggccgagagcaaaaacagcttgccggcgaaaccggcggtgggcggcagccccaccagggagaaggcggccacggccaggatcatggccagggccggggcgcgcttgtacaggccgtcgaggtcgtcgagactggggttctcgtcgtttttggcgatggcgcacacgacgtagaaggcggccaggttcatgaggatgtaggccaggctgtagaaggcggcggccgacatgccggcggccgagccggcggcaaggccgagcatcacgtagccggcgtgggccaccgaggagaaaccgagcaagcgcttcaggtcgcgctggaccagggcggccaggttgccggcggtcatggacaccgcgccgaggatggccaggatggtggtgacctcaagatggggggccacgaaggcggccagccgcaccagcaccaccacggccccgagcttggggatggtggccacgtaggcggcggtttcgtttttcgcgccctggtagacgtccgggcaccagaagtggaacgggaacagcgccagcttgtagaagaaaccggccaggaacagggtcaaaccgatgacggccatgggcgcgtcagcaaagctccaggacgtggcggccagtcccgacaggtaggtcgtgtgcttggccgcgatgatgtaggacaggccgaaaagcgccagggcggtcacggccgcgccgaagaggatgtacttgatgccggcctcggccgcccgacgatcctggccgcgaagcgggatcagggcgtagaggctgtaggaggacaactccagggccagatacaaggtgatgagttccacgcacgaggcgagcagcatcaacccccaggccgacagggccaggagcatgaagtagtccggggtcaggtccttgccttccttgttgccggcggcgatgcccgtcaccacggcgaacccgaaggcgatgagcagtttaaagaactgcgacaggccgtcgagcttgtaggcggcgtagaggaactcgccgcgttcgcccagggcgaaaagcgcggccaggacgccaaggccggcagccatgggcagccaggaggccaccgactgcttcttgtcgctgatgctggcgacaaaaagggcgcacaccagacccaacagccacagttcgggcagaagcgagaagatgctcatggatgctccttggagacggcgtcgacggcctcggccacggccaggggcgcggccaggttaaaccgctcggccatggacatgtccttgtgcagtcccatggccgtgttcttggcctccatggcggacagcacccgcgtgatggagggctcgatggttttgatgcaaagggccggggccaggccgatgtagaagaccaggatgccaaggggagcaagcgtcacccactcgcgcagtcccaggtcgccccaggacggcttgtaggcggccggttcgccccaggtcacccgctggagcaggcgcagcatgtaggcggcggccagcatggctccgggcacggcggcaaagcccacccaggggttgccctggaaggccccgatcaggaccagcacctcgccgatgaagctgttggtgccggggaaggccagggaagacagggagaagacgccaaacaggaacatgaaggccggcatgaacttgcccagcccctggttgtcggcgatttcgcggctgtggctgcgctcgtagagcaggccgatcatcatgaagaggccaccagtggtgatgccgtggttgagcatctgcaggatcgcgccggacacgcctttgacgctaaacaggaagatgccaagcgtcacaaagcccatgtgccccaccgaggagtaggcgatgagctttttgatgtccgtctggccaagggctatgcagccgccgtagatgatgccggcgatggacacggcgatcaaaagcggcgcgaaggtctcggccgcggccggggtgagcggcaggcagaagcgcaggaagccgtaggtgcccatctttaagaggatggcggccaggagcacgctgccggcggccggggcctcgacgtgggcggcgggcagccaagtatggaacggaaacatgggcaccttgatggcaaaggccagggccatggccaggaaggcccagaactggaacttgaaggcgtagctcttttccatcagctccgggatggagaaggtgccgcccacctgcctaaaggccacgatggcggccaggagcaaggtggagccggccagggtgtagaggaagaacttgatggaggcgtagcgccgacgggggccgccccagacggcgatgagcaggtacatggggaccagcatggcctcccagaagacgtagaacaggacaaagtccagggccgcgaacaccccgatgcacgaggcggtcatgagcagcaggcagacatggaactcggtgacgcgcttggcgatgtaggtccaggacccgagcacgcacaagggcagcatgagcgccgtcaaaaggatcatgtagaggctcaggccgtccacgcccaggtggtaggtcatgcccagggccggcagccagtcggctttttccacgaactggaaggccgggccgtcagggacatagccgagaagcggcaaggaaagcaggcattcgaggatgccgacggccagggtcgtcatccgcaccgtccagtcgcggcgcataaacagcagcgccacggcggcgacaagcggcacgacaatcagcgccgtcactaccgggaatccgttttgggtcatcatgagtatcgctcccttccctgcccgttaccgcagccacacgaccacgaacacgaccaggccgatggccacggcggcggccagataatcctgcaaccgtccggtctggctgcgggcgaccgtcgccccgccgacctcgcgcacgcccttggccgaaccgtccaggacgccgtctatgaccttgacgtcgaacacgctggtgagaaagccggcctcgataagggccttgagcccgatcttctcgtagacgtcggtccagatgttgtcgatggcggcggccggcacgctgacgagcttcacaaaccaccggccaataaggcggtagaggatgtcaaagtcgaggttgcggctggcatggggcggaatgatggcccgcatgaggtagaacccaaggccggtgaagcccaggatcaggcaggcctggagcacgtgccaggcggtgtagggctggtagtcggtggggtacggcaagatcccgtagagcagatccggaaacaggcccgtgcccaggcacaacagcgacgagacggccatgcccaggtacatgttccaggggatgggctttaattccacggtgctcttgggcttggcccagaaggcgaagtacggcagcttgatgcccacggaaaggaacgtgcccacggcggccagctccatgcccagcgccagccaggtgcgatgggcctcggccgcgccggtgatggtcatggtcttggagacgaagccgttgaaaagcggcatgcccgagatggagaccgcgccgaccatgtagcagatcatgacgagcggaagccgggaggccaggccgccaagctcggtgagcttggccgtgccggccgagtacagcaggcagcccgcgcccatgaagagcaagcccttatagaggatgtgggcataggcgtgggcgcaggccccgtcgatggtcatggccgtgccgatgccgataccgcacaccatgtacccgacctgggagacgatgtggtaggacaggatgcgccgggcgttgttctcgatggtggcgtagaagacgccgtagaggcacatgaccacgccggccacggccaggatgtcgaagccggcgtaggcccgggccaggacgtagacggcggtcttggtggtaaaggcgctcatgaagaccgcgccggtgaccgtggcttcggggtaggcgtcgggcagccaggcgtgcagcggcacgcaggcggcgttgaccaggaaaccgatgaggatgatgtagtcgtagtagcgcgcggcctcgggggcgacggcggtgaaggcgaaggtgcccagttccgagtaacgcaggagcaggccggccaggaggaacaggccgccgaagatgtggaacaggaagtagcggaagccggcggccgtggcggcttgggtgccgcgcagccagatgaggaagaccgagccgatgctcatgacttcccagaagatgaacagcgtaatgtagtcgccggcgaacacgcagccaaacccgccggcgatgtagaggcaggcggccatgtgctggccccggtcagccacgtgcagggcgtagatgaagccgataagcgactggatggcgaagacgttggcgaaaaccagggccaacgtgtccacccggcccagggacagggtctggccgaggtagtgcagggtggccagttcgcgcgcgccgtcgccgccaaaggtcagggccatgaccgagaagatggccagcaccggcggagccaggagcagccagcgccaggtcatgtagcgttcgttggacagaaaggccatgaccagggccagggccagaaacccgatggaaggatggaggaaatggatccccgcgagctgatcaaggccggccattgtcatcctccggacgcgccaacacggggtagacgatctttttgagcacatagaccatggctatggccgctcccagggaaaacacggcccagaagccgggcaacccttcgccgacaaagtgcggatgatggggcgttataaagagatttaaggccaccagcgccccgagcactgtaaacaaggcctttttccaggcgtccgccctggccctggccgcttcgagccagctccccagcagttgcggttcccgcatgacgtcctcccttgcttccgaaacggcgcgttctgcgcgccggcagctttcatttcacgcgaccttgggccttgcgcccgaggtctccaaccgcccggcttctcccggtcggccggtcatggccacgactcccctgccctcacgccgcgcgcgcccatggcgggcagcctgcgtcggcgcgcctaaccggcgaaatacgggcgtatttcgcggcggggcttgcctagaaccctccgaacacgtcggtaaacgagccgaaggttcccgggaaaagcccgagcagcacggagatcagcgctgtcaggcaaaggggcaccaccatgaccatgggggcctccttgaagtgggaatgatccacgccctcggccgggggccggaaaaaggcccggtagaccaccggcacgaagtaaccggcgtttaagagcgtggaggcgagcagggccagcagcaggatgtattgatggatgctgacggccccgttggccagataccatttggtgacgaagccggagaccggcggtacgccgatcatggacagggcggccacggcaaaggccccgaaagtaaacggcatcttgcggccgatgccgtccatgagcgggatctgtttgaggtgtgtggccacgtagatcgcgccggcggcaaaaaagagcgtgatcttggcaaaggcgtggtgggcgatgtggagcagcccgcccttgacggccaggggactgagcatggccacgccgatgatgatgtaggacagctgactgacggtggaataggccagccgggctttgaggtcgtctttagtcagcgcgatgatggaggccaccacgatggtgaaggcggccaggtaggcggtgatgagtcccaggcccaggctggacagcagatccacgccgaagcaggacagcatgatgcgcgacaccgagaacacgccggccttgaccacggccacggcgtgcagcagggccgagaccggggtgggcgcgaccatggccgagggcagccagttgtggatgggcatgagcgccgccttgcccaggccgtagaggaacaggaagtaggtgatggtcacgagcttgggatcggcccccggcgggaacatgccgcgcgagatgtcgccgaggttgaagtccagcgtgccgcacaggacgtaggtgaggatcatggccggcagcaggaacagcttggaggtgcccatcaagtacaccaagtacttgcgcgcgcccttgtacccctcttcgtcctgatggtgggcaaccaggggataggtgaagacggtgatgacctcgtagaagaggtagagcgtgaccacggtgccggaaaaggccacgccgaccgcgccgaagatggccacggcgaagcagaagtagtagcgcgtctgggcgtgctcattaagcgatcgcatgtagccgatgttgtagctggtggcgaaaaaccacagaaacgtggccacgatggcgaagatgagcgagaggccgtccacggcgaaggtgatggagacgccggggaagaaggtgacgaggtggtaggtccagatgacgccgtccaggacgcccggaaccatggacaggaccgagaaaaaagccagggcggcggcggcaaaggagacgccttcccggaggttgatgtttttacgcagtcgccacagggcgagtggagccaggaacgtgatgaccaggggcacaagcacccgggcgctctcaacggtatgcacgctggcggccatggactaccccttgagttcgctgggggcgtccgccgaggcgtccccgaaccgtttggaaacaaccaagacaatggccaggaccagcgtcgcctcggcggcggccagccccatgaccagaagcgctccgagctgtccgagcacggcgtcggccgaggtcagctgggcggcggccacgatggacaggcccgcgccgtttaacatcagctccacgccgatgagcatgccgaccagcgtgcgccgggcgaccagggcgtagaggccaaggccgagcaggagcagggccacggtctggtagaagacaagcggattcatttggcggctcctcgcttttcaaaggccagcagcaccgcgccggccatggcggccaggagcaccaccgaaatgagctcgaaggccatggtgtagggaccgagcagtccggcgccgagttcggccgggctgacgtttttgggggtggggaatccggccacgccgtagacggccaggcagggcacgaggatgccggccgggagcagcgccccgaacaccccgcgcaggctgccgcgaagccccggcccctggccctcgccgccgtcggccgaagcccgggtgagcatgatggcgaagaagatgagcacggtgacggccccgacgtaaatcaggatctgcatgagggcgacgaagtcggccaggagcagcagatagagtccggcaacgccgaaaagggaaacgaccaagccaagcatggcccgaacgaggcttgccgcggacacggcgaggacgccgccggcaagggcgatcaggctatagaaggcaaaggcggtctgtccaaggtacatttcattcataagcgccccgctgttctcctcgtaaggcttattgacttcttcaaactgaccataccgagcaccccccagtcaacgttgcgaattctaacttatgttacggcaaaatattcacatacaaaatagaatttaaaaaatcaaacacggctttaaacacgatcatatgatgctatgttatttttacagacaaatttgttttgtttaatttgtataaaatatgaatactatccgattttaataaaattcattcagtaaaatattcgttcaaacgctacaaaaaacatcgtggcatgtgattatttttcacactgcattgctatatataaatttcacaagctaattacaacaatttcggaatagactatcagccaaagcgtgaatttaataacaagtaaaccttaaaactgctgtctggctttgtatcacacgctatttcaagaacagctaaccgtgcatgacgtgcgaagctttcaaagaacggtaacacgcgaggcgggttgcttatatcgttgaacttcgggcgtcgtcaagagacaataatttgtcataatcgtagcagatacttccggcgcacgccagtacgagcccgggaaaaagttccctactcacggctttttagccaaaggcacagaattaaagatttgaattaatttagataattaaaaattgacgcaatcgcccccagagagaggcccggggcggattcaggaattgcttcacgttgcgatgcaacagggcgacgccaaaaagtttgccttatgataattccttcacaatcaaacgtagcgacacggtcgaaaatacccgacgccttgcccgcctccagaactttccctggctgctccagaaatcccccccaccacggccgcaccccgaaaaccgcgtcatgacaccgccccatccccacctgaagaaggcctccacggctataatcgacggctccaccaaaaaaacgtctgacgacaagcgcgaaaggccccaacacctcattgccagaaggcctgtcctaacggtataggggcgcttcggcggaatcccggcccggccgtgcgcccggcccaaccaccgggaccattgccccggtccgggacaaggccccggcgcttcggcgcacccgccaggcgcgtggcgttattgctgttgcccttcccctgggcgggaagtcggcggcagtgcgtccgtcggcgtggattgaaataaaaaagcgtcttgctgcggcagggtataacgcccgggacgagacgccatggaccaagccccttcccaaggaaggacaggcactatcgcctccacccgcaaccttcggagcccctttgtcgtttccttccttaaccatcggtgaccttaccatccccagggccatcatccagggcgggatgggcgtaggcatctccctttccggtttggcttcggccgtggccgcggccgggggcttcggcgtcatctcggcggccggcatcggcatgaacgagccggatttcggctccaactacatcgaagccaacaaccgggtgctggccagggaaatccgggccgccaaggaagccgccccaggcggcgccatcggcgtcaacatcatgatggccatggccaacttcgcggagctggtcaaaaccgccatctgcgaaaacgtggacgccatcttttccggggccggcctgccgctggacctgccgggacacctgcccgaaggcgcgcgcaccaagctcgtgcccatcgtgtcctcggcccgggccgccgtgatcttatgcaaaaaatggctgtcgcgcttcggccgcacccccgacgccttcgtggtcgagggccccatggccggcggacatctgggatttaaggccgagcagatcgacgatccagactttgtgctggaaaagctcgtcagcgaagtggtggccggggtcgccccctacaccgcccccaacggcgcgcccattccggtcatcgccgccggcggcgtctacaccggcgccgacatccgccgcttcatcgagcttggcgcggccggcgtccagatgggcacccggtttgtcgccacaaacgaatgcgacgccgacgaccgcttcaagcaaagctacgtcgaagccacggaaaaagacgtggtcatcattaagagccccgtgggaatgcccggccgggccatccacaacgagttcctcgaccttgccgccgagggctccaagacgccagcccgctgcccttaccgctgcatccatacctgcgactacaccaaggccccctactgcatcaccctggccctggccaacgccaagaaaggccggctgcgccacggctttgcctttgccggccagaacgcttggcgggtggaccgcatcatgtcggtggcggatctcttcaaggaattggtcgaaggctacgaagcggccgaggccgcctcgccggcctaagcccccttcctccctggcaacgccaaaaggcgcggcggaccggacacccggccgccgcgccttttacttgcgccccagaaacagaaaatatcgccacaagccgccgtaagccggccgcgcctcatgacggcagggctggaaacgggactgcagttcggggacgagatggccgtcaagccgcacgtggttgacccccatccaggcccggaaccagccggccggcgtattgtggaaatcgaccacggcaagaatcccacccggagccaaatgctcccgggccgcttccagggccgtgtcccagccgggattgaacatggtcagggcataggaaaagatgatgagttccagggaacccggcgcgaacgtgtcggggccgtaggccgcgcaacgcaaggtcgccgcacaggccgtgcgggatacggtccgtccagcgcgctccagcatgggccggcacaggtccacgccggtgagcgacgccccgggcagcgcccgggacaaggccaggagattgcgtccggtgccgcagccgacctcggccgcccgaaccggccgctccaagccgtcccgggccacggcttcggcggccagacgcaccagccggtcgcggccgaacagaaaactccagcgcgtggcgtcgtagatgcgggcgtggaaccggtagtagccgggcaggggcgaagcctcagccgccatcaggccaccaccgccaaatgctggctgccataggtgccgacccggtcggcggcgtgcagcgcctcggtcacttccgggaaaaaggtcaaccgccgacgggccgcctcgggcagaaacgagacgtccaatccggccgaacgcatgagcaccctggccccgggcgcggcaacggcgaatatgcgctcccactcctcggccagggcggccggatcgtggttggccagccagtcctgatggtccagcagcacgaaatggctgtaggggccaggatgaccggccaaaaagccgctgagcgagtccgtatgggtcgtcagccggccaaggcgctctcggatcgtctcgaaatgctgttccttcaaatactccgggcaacactccggggcgtagcgaccggtgagatagacccgccagaaatagttctcggccatggcggtttcggtgaacacccggcgcaccttctcgcgcacgaagccctccaacccgcccggatgggaatcgcggatgagcgcgatctgggggcgcggcacgccaagaagggccatgagcgccggccgggccaccagccagcggctcagccgatcccagaatatcggctccaccgccgtaaacgcccggcgctgctcctcggcgtcgcgggcggccagcagacgcggcagctcgcgccgcagcccgggcttgagcagccccaaaagccgcgtgaacaaaaaggccgccgccccggacgcgccgtggtggtaaaaggaacgcgacaaccggccgcccttgaaatacgcgatgttcttgtcccaataggccgccgtgtaggccgggagatgcccccgcagccgggcgtaggtcgcggcgcaggacggcccgccgccctggccgaaaaaggtgaagagttccttgaaggatgcccggcagaaaagcgcccgcttgagttccagcaaggcgttctggcggaagttgaggtccacgcaggcgacctcggtcggatcgtccagcaaatagtccaacgcattgtcgccggcagaagtgatgaccaccacccgcgaatcggacccaagcgccaacagacgccgatccagacgcgggtcttcccagcaggtgttgtagacaaggcggttgccatggacaaaacggaaaaaagcgtcgcccagacgccgtgacacagtaaggttcatgtccgccgtctaccgccgccgccgcgccccgacaaacgacgtttacgtgacgcattgtcgcgttattgccatgtgacaatgaagaataaagaggcctccggcggccgggggcctgaggtccccggaccccccatctggaagaaaaagggggggcggcttcgccggagagtcattaacgatcttgcttgctcttcctggaatcttcctgtttgggggcgcggtttccgccaagttcctcctgacggaaaccgcgcccccaatcagggagggtccgggagggagtaaccccctcccggccgccggaggcatcttcccctctttttcttattttcccttcatcttacgcctgtcttcaatcttccaggcccatacggccatggcgatggccacgcagagcagcccggccagggcatggaacaccccggcgataccagcggccagggcggccggcggagcgctggcgaagtcggcatgatcagcgatagagccggtggcgtggacgatgccggagaaaatcgtggccaccagcggcaggccggtggattgcccgaacacccgggcgtagttggccagccccgaaccgacgcccaggcgatggggcggcatctgccccatgatggtcgtgttgttgggggcctggaagatgcctatgccaagccccaccggcatggtgcgcagcagatagccccaccacggcgtgtgttcggtgagcgtgcccagggccagacagccgccggtcaggaccaccatccccagcaggctcatgccccgggctccgtagcggtcggccaggctgccggacaccggagcggtcacggccatggaagccggcaggatcatgagcaaaagccccacctgggtgacgctgtagccttggccggcttgcaggaaaaacggcatgataaagccgctggctccggtgacgaagaccagggtggccatggccaggggcagggaaataagcgggttggcgaaaaggctcaggtcgagcatgggggccgggctttggcgctccaccttgatgaagacggccaaccccagggcgctggccgccaggagaatcaaggccgtggcgtcggtggggccgtggcgctgcatgaaggtcatgcccaggcagtaacaggccagggtcaggcaggcgatggccgcgccgggcaggtcgaagcgttcgccccggcgttggggcggcagggccggcatgaagcggacgacggcgaaaagggccagcagacccaaggggatgttgaggagaaacagtgcgcgccagcccagcaggccaatgagcacgccgcccaggggcgggccgagcatgaggcccatggccacggtggccccgatgaatcccaaggcccggccgcgactggagggcggggcgagctgggtgacgatggccatgcccagcgcctggctcatggccgcgccaatgccctgcatggcccgaaaaccgatgagccaggacaccgacggcgccaggccgcagcacagcgaggccaggagaaacagcacaaggcccgagccgaagatccgctttttgtcgtacatgtcgcccaggcgcgacaccagaagcagcaggctggcgatgaccaggacgtagcttaaaatgacccactggatggtggcgaagtccgtggccagactttccgtcagggtgggcagggccacgttgacgatgctcatgtccagcgtcgccatgaacaccatgagattgacgccgatcatggccagggccgggcgcggggtcgggacatggccggctggggcggtatggtcttgcatgaaaacggacttccttggctggtcgatgccgccgtgtaccccaacgggcggcggcggggaagcggattatccggcggtcggcaggcgatggtcgagggaaccgttggtaacggcggcaaagagccaatgggtgaagcgggccagactgtccgggtcgcagccccgggacaggggatggcgggcgagcaagcggtccatggccggcggcagggcggccggccccgcctcgcccggctggcgggcatgggcggcgagcttttgcccgacgagattgacgccccggtccaggagcagttggagcggcatggggcaggccagctgccattcgaggtcaataaaacgcacgtcgcctgtggccggatggcgcaggacattgccgggatgggcgtcgagcaggctgccgggcagccacggtccggccatagaaccagtatagagctcccggcccagctgggcgcggcaaaaggcgacaaaggcctcggccgccccgggcatggccggtctggcccgggaggcagtcagctccatccactcggtgaccaagcggccggccccgaccggatcgccgtcttccacggcgtcaagcaccagctccagatagctggcgtagcccaggcgatacgactcggacggcttgacgctctggcggccggcggcaaagacggccggcggcaggccgtggaggtttcgccgggtgacggtgacgccgcccgcgccgtcatcgacgaaccgcgtcatggtctggaaatgcggtggacaggagtcggcgttgacggccacggccagggtcgccgcgttggcggccagcaggggcgcgtcggggctgggcgcggccaggacgagaaaggaattcatgaaatggccggccacgccgccggccagggccgagcgcataaaggcccgttcggtgaaagccggtgcggcccggccgccgggatcggccgtgggcagctccagcaggggcaaggcggcaaagccgggcaggccaagcgcccgctcggacaggacgctgtcgggcatcttgtaatccggggacggaaagtgccagcttgtggcggcaaacccggcccgggccagcatggcggccagggttggccggtcgaaggtgcgcacgcccgggttgccggggtagccgtttaggccgtcgtagggccggccggtatggtcctcgggcaggccggccaggtatttgtggcccatgcggttttcgatggccagcaccaggcagccgcttggggcgagatagcgccgggcctcggtgagaagcttgtggtagggctcgggaccgtccacgaaggccccggcgtattctagaacacccaccagggtgaccacgtcgaagcagccgttataggacagccccacggcgttggccgtgaccacgtccagattggcggcgtccggcaggcgggccttgatgacggcggcccggtcaggcgaaccttccacggcggtgaccgcgtggggcaggctggtcaagtgggcggtcagcgcgccgcagccggccccgagttccaggatgcgcccggtggggccgaaatccagccaggacagcaaggtcttgcggcgcggcgagagatggtagcgcacggcccagggcgcgtccttggggtagagctcgtattcgttgaccctgcggtcgcgaaaaaaacgcaacagccaggcttccgaaccgtcgctgtaggccacgggccgcctgtcatccgaagcgtttggctggtcctgggattctttttcgtcgtcggccacgggtccgtcctagtttcggctattgccgggcgaaccattcggccaggcggtcgcaggcggtgtcgatctcggccggctcggctccgtaggacaggcgaaggcttccctcgccgcccggcccgaagctgtcgcccgggatggtaatgacccgggcttcgcgaatgagccgcgtggccacgtccatgggcgcgcccgggaccggatagcgggccatgatgtaaaaggctccggccggcgcgttgtaggccaggccgtcaatggcgtcgaggcgggccatgatgcgcgcccggcgctcccgcagggcgtcgatgaagccggcgtagaccgcctgggggccggtgagcgaggccagggcggcgatctgggaaggggtcggggcgcagatagccgtacagtcgtggaccttgagcatctgccccatgatcggctccggggcaaaggcaaagcccacgcgccagccggtcagggcgaagcgtttggaaaagctgcccacggccacgaggttgtcgcgcagctccggcaggctggccagggaaaaggccggctcgtcataggccagggcgtcgtaggtgtcgtcgcagatgatggtcagtccgtgggtcaaggcgacctcggccacggccagcaggtcgtctttggcaaagaccgcgcccgtggggttgtggggcgaattgatgataatcgcccgggtgcgatccgtcacggcggcggccacggcctcggcgtccaagctccagtcctggcggcgcaggggcacaaggacgggctgggcttcggccaggagcacctgttccacgtgggagggatagaacggctcgggcacgatgacttcgtcgccgcgctcgcacaggcacaaaacggcgcacaacagcgcctccatgccgcccacggtgatggcgatttcccggtccggatcggcgatgaggcgtttttcggcggccagcagatcggccacggcccggcgcagctcgggcatgccgggctggagcgagtacttgccggccgagggctggtcggccaaggcccggcagacggcctcggccacgtggggcggggtggcgaacgacggcacgccctggcccagggaggcgcagccgccgacctcgctggccagcatgggcatgagcttggtggcggaaatcttgatgttcttggcgcgctggctgaagcggtgggaaagacttgtcacgacggctccctacgacatgcccgggcttgtcggcggcccggggaaaaaacggcgctggccggggcggcaacaacggcggatgccgtcgttgccaagggaaacgggcaatccgccaagaccacccggcggcgaatacacagcccgtgctgggcggccggggccgctctactgcggcacggcaatcttgggatgggacgaggccggggccggagccaggggcggcgcggccagggccttttcaaattcggccacggaatagccggaaacggcccggccgttgatcatgaccaggggcacgccgcggccgccgtagcgtttgaagcgcatgttggcggtggcgtccttgtcgatgtcatacatcgtatagggaatgcccttgccgtcgaaataggccttggccttggtgcagtaggggcaccagctcgtaacgtacagttcgacggtcgggccggcggcgcgggccggggcggtggccgcaaggacggccaggacgaggcaggcggcggcaaatcggccaagggccgggaaaacaatgcggggcatggcgtgcttccggttgggggttggcaatcactggtggtagccggggggagcgggctgcgtcaagccgggcgtgctcacggcggcggttgccggggcggcacgggaggtgctagggaggcgcccatgccggggtacaagacgcatatcgtgggcgcggcggcggtgaccggcggggcgctggccgccacgtcgtggctgggggtctatcggcccgggttcgagaccatggtctgcctggggcttttttccgtgttgggcgggcttttcccggacgtggacaccgattccaaggggcggcgcattttttacggcgcggccctggtggtggacgcctttctcattttccgggagcaataccgctatgcggcagtgctgggcttttgcgccctgctgccggccatcggctctcatcgcggctggacccactcgtggtgggcggccttgcttatcccaagctccgtgctgctcgcgcccatgctgcttctcggcctgccgtggaagcccttcctgccgtattacgcggccacggtgctgggctatttctcccacctgctgctggaccgcaaattctagcgtcgcgccccttaaaaaagacgagattttttcagaaaaatccgtggcttgggtttgttacccacgaaacgccctagaggcgctttccgtggacgcggcacgagcgtcgtatctcccacgtcttcatccttacggcgtcaggtgcaggccatcgacaaggccctggtactgcggcgtggcgcgaaagctttcaatggcggcgtcgagacgagccatttccccggggctgacgcccaggccgcacatgatgtggcgtcgtccacccaggggggaatcggccagacgcacgatccgtacgtgcttgcgcaaggcgggcttggaggcaaatatccaagccagctcctcgggttcgaccagcatggcgtccagccggtccttggccagcagttcgaccatatgggccgtgtcggcaaaacgcttggtcgccggatacgcagccaggagctggtcgtattcagcgccataggaaaagccttcgcgcaggccccagtgccagcctgcggcgagcagatcggccagaaaggggctgcaggtctcgggcacggacaacgtggcgcgcacggccacggcggtgggctggttgcggtagaggggttcgctgaagcgggcaaaggcctcgcgttccgcggtcttgtaccagcccacggcacaggcccggctcgggccatccttgagcatggccacgacgcggcccggcggcatttcgcgcaccgtcacggggataccggcctgggcaaagacggtcagagccgtggtgagcagaaaaccgcccgaaggctggccatgttgcagttgataatagggagggcggtcaaagacgagcagcgacaaaggctcctggctctgtcccgctgttggcgtcagagccgggaccagaagagccagcgccgccaaaacggcacgcaacagacgtcgcggcttggtttttttcgggaataaccgcgttacagtccttggcggcagagattccatatacccttttgttgcgaaaaaggtggccaatgtcaaagggcgattctccgtcgatacatgcttgcattttgtcagacctagtgcatagataaacagtcaagccactttcccgtctccacgacggcccgccgcgcttaggggagcgacgccagcatgagcaataccaacatcctcctggaatccggcaccaacgaacttgaaatcgttgaattttatttggaggaacccaccccgtccggcaagacctacaccggttactacggggtcaacgtggccaaggtgctggagatcatccgcctccccaaagtcacggagatgccgcaaacgccacacccctgcgtgcttggcaccttcaacctgcgcgacaaggtcgtgccgctggtggacctcagtctgtggctcggcaaggaccgctcccgcaacgcttccgacaaggtggtggtcacggagttcaaccgggtggtcagcgcctttcgcgtctccggcgtcacccgcatccatcgcctcagctgggaacagatcgaaccgccaagcatccaggtgcagacctattccggcaactcggtcaccggcgtggtccagctcgacacccgcgtagtcttcatcctcgacatggaaaagatcgtggccgacctcaacccggaactggccctcaaggaactcgacgaggtcgtcttcgtcgagcgccagaaggaactgccggacaaggacatgatcttcaaggcgcttatcgccgacgattccaccaccatccgccgcatgatcggcacctcgctggaaaaagccggcttcgaggtcacccgcaccatcaacggccgcatcgcctgggaccagctcgtggaatggaaggatgccgcgacgaaggaaaatcggcccatcaccgatttctgccatatcctcgtgtccgacattgaaatgccggccatggacggccatagcctcacccgcaaggtcaaggaggacccggtcctcaaacgcctgccggtgatccttttttcctcgctcatcaccgacagcctgcgccacaaaggcgaagccgtcggggccgacgaccaagtgtccaagcccgaaatgctccagctcgcggaaaaagcccgcgccctggcctgggaccgcctggcccacggcgaatagcagaaatcaagatgcctccggcggcgaggaccttacgcccccggcccccgaaagcggtaaaagggatgtcaggccggggctgcttcggtcgtctggccggccgactcgaacaattcccgccgcacccggtcgcgttcacggtcaatctgctcggcgctggcccccagttcacgcaggagatacgtggacatagccaacgccacctcgccctcgccggaaaaaaccgctttcgccccttcctggcgcagcgcctgggcctcgcgcaagtagccggcccggctgacgatgcgtatctccggccgcaactccagggcggcctccacaatctcgcgcgccggcaaacccgaggccgtgataaaaaggctggccgccgtctcgacgccggcgtggagcagaatctcccggctggccgcgtcgccgtgcaccacccgcttgccggacgcggccagggcgcgcacggtgtcgatgttcatctccaccaccaccggctcaatgccgttatcggccagaatacggcacagcgtgctgccaaccggcccatagccgaccacgatggcggacaagctgccgccggccgcctcggccgcgtcttcggccgtgggccgtactgtccggccccgtccccgagtcagccgcgcggccagaggggctacgccctgatacagccagggattgacgaggatggagaccaccgaggcggctactaaagccgtgcccgcttccttgggcaggatgcccaggctcgtggccaacgtggccaggataaacgagaattcgccgatctgggccagggccgccgaaaccgacaaggccaccgccaggggccggcccagggccagcaccacgatgagagcggctagcggcttgcccacaagcacgatggccagcgtcgccaaggccaggggccactgggccgccaacgcggccgggtcaagcaacatgcccacggacacgaaaaagagcaccgcaaaggcgtcacgcatgggcatggcgtccgaggccgccctggccccgaattccgattgcccgacgatcatacctgccaagaaggctcccagggccatggacgccccgaaaaagaccgctgcgccgacagccagccccaaggccgaggccagcacagccagggtgaacagttcgcgcgaccccgtgcgggcgatgtgtccgaaaaagcgcggcaacacgtagcgcccggccacggccgccacggccaccagggcgaaaagcttgccgccggccacggccagggtccggcccaggccggcctcccccgcccccgggccgtaaagcgtgggcaaaagaaccagcaccacgatggtgaacagatcctcgactatgagccagcccacggcaatgtggccggtcggggtgtgcagggccttgttgtcggccaagacgcgggtcagcaccaccgtgctggccacggagatggccgtgccgaagaccgccccggccgtccaggaccagcccagggcgtgggtgaccaccgtccccaggaccgccgaggccgcgatctgagccacggccccgggcacggccacgccgcgcacggccaccaggtctttcaaatgaaaatgcagtcccaccccgaacatgagcaggatgacgccgagctcggcgaactggttggcgatggagccgtcggccacaaatcccggagaaaacgggccgatgcagtagccggccacgagatagccgacgatgggcgacagcgccaggcgcttggccacaagccccagggccagggcagccaccagaccggcggccagggtcacgatcaggtccatgtcgtgcggcatcaagcctccttgccgcaacacggagagccgccgccggattgggcggcgcaaacgtcatgctgcagggcgttcagcgggccgggcctgcccgtcccgccaggttatcgatcagagttgcaggaattccttgctgccgcacagcggacagcagctcccgcccggatgtttcgtgccgcaggaggcgcaggccacttccacatccccgccttcgggatgtttttcgccgcacaaccggcaatgggtgaaatccggatcgttttcggcctggcacttggggcaggtccacggggcgcgcggttcggacatggctggcctcctgcgtgttgcgcggcgctgcaaggcccgcgttggagccaccctacctgaaattgtcgccaaaagccaagacgccgccatgtttgccgcgcaccggcgcattgacaccccagcccggcctccggtaggccctaaccatgtacgacgcgccgccctcctccgaggctgaactcgccgctgggcaggccaaacgcctgcaagaggcggtggagagcctttttgcctgctgtcagacccgcattgccctgcaaagcgaacggttcggcctgccgccggccgccatgcgggcgctcattgccctgggcgaaacccgctatctggcccccggcgaactcggccggcgtcttggcgtcaccaaaagccgcgtcacggcgctcaccgccgacctcacccgccggggcctcatcgaacgccgccccgacccgggtgacgcccgggtgacgcttttaagcctcaccccggccggcaagcgcgtgcgcgaggaagtccgggaattcctggccggcctgttcgccggcatgctgggccatgtggccccggcccagcgcgaagccctgctcgcttccctggacatgctgcgtcgctgcatggacgccgtacgcgccgacatcgccggctaaacgccgccccgcccacccttttccctttaggccccgcccccgacgaggcacttcacagcattgcccctttggttcatagtgccgtccatggaaatccccgttctgcccgacgtcaccgttgttttcggcctggccgtagtggtcatcctggtctgccaccgcatgaaggtgccggccatcgtcggcatgttgctgaccggaatgctctgcggccctcacggactgggactggtccgctcggcccacgatgtcgaaatcctctcggaaatcggcgtcatcatgctgcttttcaccatcggtctggaactttccctggccgacctgtcgcgcctcaaacgcccggtcttcatcggcggttcggcccagatggcgctcacctgggccgtttttttcgccgtgccctactatctgctggatttctccggcggctcctcggtgctcatcggcatgttggccgccctgtccagcacggccatcgtgctcaaaactctgcaagagtgctcccagatggaggctccccacggccgggtcagcctgggcatcctcatcttccaggatttgctggccgtgcccatgatgcttgccgtgccgctgctggccgggagcaccttcggcttcaccagttccatcatctacaccgtgggcaagggcgcgctcatcttggttctgctggtctttttcgccaaaaagatcatgcccgggctgctcctttccattgtccgcacccgcagccgcgaactgttcctcatgaccgccctggccatctgcatggccgtcagcctgctcaccgcctccatcggcctgtccctgtccctgggggccttcctggccgggttgctcctgtccggctcggactaccgcgaaaatctccacgaagccgtgctacccttcaaggacgtcttcacgtcgttgtttttcatttccatcggcatgttgctcaatgtcgggtcggcctcggcccatctcggcgaagtgatcctggcggctctcctgctgcttgtcaccaaggccgccctggccggcacggcggcccgcatcctgggctacccgacccgcaccgccgtgctggtcggcatggccctgtgccaggtcggcgaattctccttcatcctggccaagaccggcttcgacaaggacgtcatctccgaacatttctaccagaaattcctggccgccagcatcctgaccatggtgctggccccgttttgcattaccctcgccccgcgcatcgccgccctggtctgccgctggctgcgggtgtgcgacgcgccagacgaattgcccgccgcccactacagcaaccacctcatcatcctgggcttcggggccggcggccgccaactggcccgggcggccaaaaacgccgaaatcccctacgtcattctggaaatgaacccggacacggtgcgaaacgaagcgaaaaaaggcgaacccatcctgtttggcgacgcctccaagcccggggtgctgtcccacatctgcgtccaggaggccaaggccctggccgtggtcatctccgacgcggccgcctcgcgccgggccgtggagatcgcccgccaggaaaacccggccctctacatcgtggcccgcacgcggttcaacaccgaaatcaccgccctactcgacctcggagccaacgacgtcatcgccgaggaattcgaagcttcgcttggcgtcttcacccgggtcatggacaagttcatgatcccccacgacgacatagagcgcatggtggccgacatccggcgcgagggctacaaatccatgctgccgggcagcttcaacgagctagccgtccatgtgccggacaagtccctggccgggctgcacgttgcggtgttcacggtggatacggcctcgcccctggccggccggtcgctcatggacgtgcatctgcggcgcgaacacgacctgaccgtggccgccgcccggcgcggcgaagagttcgtgcccaaccccgatggacccttcgtgctgtctgccggcgaccggctctacgtcatgggcacggctgaggccttgaagaaaggggcggggctgtttcggggagcttgagaggagagaagaagaggcctccggcggccaaaggggctgagcccctttggaaaccccacctggggagggccgggtcagcgccgggtcttgaaggcttggcgggccgccgccagatcaaacagcgcgtggcctacgctcttaaaaacgattggccctgccgggcgcggcggcgcgtcgtcaagcacgttctccacgggcgtcacccgcccccaatccacgccggcccgcagataatccccggcctcgaccttggccgaagcaagatcatccacaaaaagcgacgcccgctccaccagcgaggccggcagctcggcggcttggggcgtaaacgatcccaccgccgcgacaaacgccccgtcccgcacgttgtccacaaggaccggctcggaactcgtcgtcgccgtgacaatgagcccggcccgggccgtcagccggtcgcgctcggcttcatcggccgtgacggccaccgtgacgcccatggccgccagttccctggccgctgcctcaagcagcaccgggtcgcggccgcacaacacgatttcctgcaccccaaggccctgccaaaaggccgccgcgtgcccccgcgcctgcaccccgttgccgatgatgaccagcggcccgcccggttccctggccaaccgccgcgcggcaagcagcgtcaccgccgccgtacgccgggccgtgaccgtggggccgtccaggcttcccaaccgctcgcccgtggccgcgtccagcaccgtcacctcgccctggatcaccggccgctcccggttgccgggatgcacggtgatggtcttgaccacggccatggccccgtccgccgccggcatgcacaaaagcaccccgccaggcacaggcacggccagacgctcgggcgcgaaagcctcgccggccttcctggcccgcaacacgtcggccacggcgtcggagagggccagatagtcgaaaaggccgacaacggggggtgtggcggtggttgtggctgtggacatgggggaggcctccggcggccggggggatgatccccccggacccctgcaacgggaaacaatttatggggccaggaacgcgctgtttcaaggtcgcaaagaataaaagggagccattgaagcttgccaaccgacgcagttccggcggccaagcgatccacgctccgtcaccctaccgccgcttgacacggatggcaaaccgcccgccaaagcgccgcatccaacaaaaaggccggagcgccatcgacgctccggccttggataagccaatcccatttgccgcgcgttgtcgtccgcgccgccagccggcatcaagccggccagattccccgaggaaactcgggctcgccgcctaggcctcgtccttctcggccctgtgtcccaccagccaggtctgcagctcgtccatgtaggtgtagaaacatggcgtgagatagagcgtcaccatctgggagatgaccaagccgccggcgaccacgaggcccaaaggctggcgggcgtcgccgccggcccccatgcccagcgcgatggggaagatgccggcgatggccgccaccgtggtcatcatgatggggcggaaacgcacgatgcagccctcgaacacggcgtcaaagggcgacttgccctctttctcggcctcgatggcgaagtcgatgaccatgatcgagttcttcttgacgatgccgatgagcatgatgatgccgatgaagccgtagaggtcgagctgtcggccgaaaaccagcaaggtgatcaagccgcccagcgccgccgaaggcagaccggacagaatggtgatggggtggatgaagctctcgtagaggatgccgagaatgatgtagatgatcatgatggccaagaacagcaggaacggcacgctggccagggattccttgaaggccgtggcctggccttcgaagatgtagctgatgttggtcggcagctcctgcttggacaaggcttcgatggccgtgacggcctcgccgatggaatagttgccggcggtgttaaacgagatggtgaccgaagtaagctggccggtgtggttgacgaccagcggcccggtgtcctcggtcatcttcaccaggccgtttaagggcaccagcaccggcgtgccgtcggaattggtctggttggtgcgcacgtagagcttgttcaaaagatccggccggcgctggtactcgggctgcacttccacgatgaccttgtaggtgtcggtggagccgtagaggttggtgagctggcgggcggcgtaggcggtcatgagcgccgtctcgatggacgaggccgtgaccccaagggcttgcgccttgtcgcggtcgatgtcgatgcgcacctggggaccgtcgatctgcatgtcggtgttgacgtcggtgatttccttgagcttgcgcatggacatggccatcttgcgggccacgggatagagctcgccgggatcgggcgagagcagcgtgtactggtagagcgccttggtctgcttgccgccgatctggatggagggcgggttgtacatgaagacgaagagatcgggcacctcggccatcttcgggcgcaggtcgtcgatgatctgctgggcgctgcgcttgcggtgctccatgggggccagaagcgggaacatggcggcgttgttcatggaggtgttgggaccgcccacgcccacgacgccgatgaacttgaacacgtccggatcggccatgaacacgcgcccgaccttgagtacccggtccttcatggtctcgaacgaggccgactgctcggccatgccgaaggcgtagaagatgccggagtcggtggccggaataaagcccgtgggcaccacggtgaacagccagaaggtcagccccaggatggccatggacaggatcatgacgaaaaagcggaaccgcagggccagatgcagcgtcttctcgtagccgtgctcgatccatttgaagatcttgccggactcggagattttgcccgacaaaaaccggctgcacatcatgggtgtgagcgacaacgtgacgaagccggacacgaggatgcacagcgtgatggtgatggccatttcgttgagcacgcgcccgaggatgccggccatgaacatgatgggaataaagaccacggccagggacagggtcatggagatgatggtgaagccgatctggcgcgccccgtccagggaggcctgcatgatctttttgcccatctcggtgtggcgcacgatgttttcgatcatgacgatggcgtcgtccacgacgaacccgacggccaggatgatggccatggccgagaggttgtcgatggaaaacccgaaaaagaccatgagcgagagcgtgccgataagggccgtgggcaaggccagactggcgatgatggtggccggcaggttgttgaggaacaagtagaccacgatgacgaccagagagatggacaaaagcagggtgaactggacgtcgtcgatggcttccttgatggacttggagcggtcgtaaaggaattcgagcttgaccgagggcggcagcgtggcctcaatgctggggatcatggcccggatggcgtccaccagctggatggtgttggtgccggcggcgcgtttgacggcgatgacgatgccttgctgctggtcgaaaaaggcggcgtttttgtcgtttatcgtggagtcgatggtctgacccacgtcttggagccgcaccgggttgccgttgcggtaggcgatgatctggcggttgtaggccgtggcgctggtcaactggccctgagccttgatggtgaacaggcgatcgatgccgtagagggagccggtgggctgcagcacggtttcgttgttgaacgcgttggccacttcgtcgatgccaatcgacagggcggccagcttgtccgggttgacctggacccgcggcgaataggtctggtcgccgtaaacggccacctgggccacgccgttgatcatggagatgcgctgggcgatgtagaccttggcgtagttggtgacgcggaaaagcggcatggtgtcgctagagacgcggatgtagatgatgggcatgtcggccggattgaccttctggaaggtcggcggactcggcatgttggtgggcaggctgccctgggcggcgttgatgtaggtgagcacgtcggtgcccgcgccgtcgatgttgcgcgacaggtcgaactgcagcgtgatggtggtggtgcccagcgagttggccgagctcatggattgcaggcccgagatcgaggtgaactggcgctccagcggcgtggccacggccgaggccatggtttcggggtcggcgccgggcaacgaggccgtcacctggatggtggggaagtcgatgctcggcatttcgctgatgggcagcgaaaaataggagacaatgccgaagaagaccagcgcggccatcagcagcgttgtcgccaccggccgcttaatgaaaagatcggtcatgactggttcccctactcggccccggcagcggcatcagacttcttgaccttgtccgccactgcctggggggaaaccggcccttccttgtaggtcgtgccatccacgatcttgatgggcacgcccgggaacagcttgatctggcccgaggtgatgaccttttccccgacggccagccccttttcgatgacggtctggtccacgatcttgcgaccggccgtcaccgggcggatttccacggtattgtcgggcttggcaatgaaaagcgaagccccggactgggtggcgaccacggcgctggacggcacgagcaacgtgtcggcggtctgggccaggaccaccgaggcgtccacgaactggccgggccacagggcccggtcggtgttgggaaacacgccctggagggtgatggtgccggtggaggtgtccacggtgttgttgatgacgttgagcacgcccttggcggccacttcctggcggccgggatagcggacgtccacggcgagctgctccttggcggcgtaggcgcggatgtcgggcagatatttttcggccacggcgaactggacgttgatgggttcgatctggttgagggtgatgatgacgtccttgttggcctcgatgaggttgccggtcttgtactgctgcaagccgaccacgccggtgcagggcgcgtagatgtagcagtaatcgagattgaccttggcgttgaccacggacgcctcgtccaccttcacctgttcgtcggcctgttgccaggcggtgcgcttttgttcgtagtcttcctggctgaccacggcctgggccacgagatcgcggaaacgcagccagtcgcgtttggcctgcagcgccgtggcccggtcccgggccagggtgctcttggcctcgtcaagcttggccttgtaggaatcgggatcaatgacgaggagcagctggccttccttgaccacgtcgccttcggcaaaaagggtcttttgcagcacgcccgtgacttgggagcgcacgctcaccgtgcgcacggcatagacatggccgatgccgtccacggccaggggggcggtggtggccttggcctccatgaccgtgacctcgaccggggtcggtttttcggcctggggctttttcttttcgcatccggccagcagcgccgagaggacaaacgccagcaaaacggcggcacaggcgctggaccgggcggccgagcgggaaatcgtgacaggcatggatgcggtctcctctcgttggcgtcgcggcgcgacgtaccaggcccaaggggcggacgctacgcgacacagcccgacaaatgccatccctctcccgcacatgcctgcgaaagtcaagggattaaccagagttgtaacgtgccgacgccggatcggccaatacttcgcttattggatggcctgcttgcccagatacggcccgtagagttgggctcggtattcggtgtcgaccagccggcgcagcaaggccacgttgacggacttgcgcaacagcgaaccgcgcggaaaggcaaaaccgtagagctgcggatcgaaaaagcccggcaaaatccgcacgtcgccggtaaaatcccggtgctggtagtaatgtaaaatgggctggtcgtggacaaaggcgtcgagatcaccgtccaccagggcggtgaggcccgcgtccaccgtctgataccggcgcacgccgatatggccggccaccagctcttcctcggcggcgctgtcctgcaacacgcctacccgcaccttgggcagatcgtccgggccatgcacccggccggtcaaggtgtccacggtcagcgacgaggtgattccggcggtgaaggtggccaaaagcgccaccgaagcgaacatccagaccatggccagagcgcgccccatgaaggttttgggcgtggcgtcgccgtagcccaccgaggtcatggtcacggccgaccaccacatgccgtcgcctatgcccttgccgccgggccggaaatgctcgggattgcgccgccgctccagcagccagaccccaatgccgaccagcagcagcagggccagcagggagccgacgtaaaagagcacctgggaagaaaatatggcgtccacgacgcgctcgacggcgctttccgccacggccggcacggcaatgcccaggcccgaatagtaaaacggctgggagaaatccatctgcgcctcgcgctcgggggtcagggacaaggccgaaacgcccacgtccacctcgcccccgcgcacggcggcgagcaatgcctccaggccgtattcccgggtggtgaagcgcaggcccaaatcctgggccacgtcctcccacagatcgtaggccacgccgacgtagttgccgttggggtctttttccacaaacggcggggcaatgaccacgccaacggtcagggtgcggccggcaaaggacggatccaccggttcgagcttggactcgcaggccccctgcccggccacggccagcaccaacgccgcgcatcccagggcggccagaagaagacggcgcattattcctcgcctcccgtcgtcggcgtcggagccggccagcgccgccgggcatggacccgccgcagcaaacgcaccttgccaaacaccttgccgcgcttttgccgcagctcctcgcgctgggcttcgagctgcatggcctcggtgcccttgggcttgtacttcaccttcactccctggaacggcacgagaatcttgttgtcctggaacacctggtcaatggtcgtggacagttcggactgcacgtcgaacttcttgatgaaattgtcgatccacacttgcaggtcgaactccagaccgagccggccaaacgtgcgcagcagcacatcgggtggcggatttttgagcacgtctttgtgctccttggcgatgccgagcaggagcttgcggaccttcttgatcttggtgcccggggccacggtgaccgggatggtcagacgcagggtggtcccctggtaggagagattgacgatctcgccgcgcaggaaactcgaattggggataatgaccgtggtgttgtccagggtgcgcacgatggtgtttcgcaccgaaaggtccaccacctccccgaggtttttaccttgctggatgatgtcgccctttttaaccgtgccgccgaacatgatgatcagtccgctgatgaagttgttaacgatgtccttgaggccaaagccgatgccaacggacaggccgctggcgatccaggtcagcgcgcccaggggcacggcgaacagatgcagggagaagagaataaaaagcgtccaggtgatgtaggaaaaggccgcgcccacggtatgggccagccccgggtccatgggcttgccccggaaattgatgaaggtaagggactcttggaaccaagcctggacgagacgcaacagaaaaaagctgatgaccagacccgagacggcgtccagggaaaccgtggccttgcccacggaaaaggtcatggcgaaaacgtattccataagccccgggccgcccatgaagatcagcacccaggcgatatagagcgccgccagcaccgtgacggccaggggctgggccaagtgggcgatggagcgcgtccggtcggccgccatggccccgagccaacgctggaccgcccccgagacgtagacggccagatagagcatgaacacggcctgcaccaacatgatggcctggggaccgaagccgaccagggccgccacgcccgagaccaaaagcagccacaccacggggcagcgccagcccaggccccgcgtcagccgccagacgcccaggcccgaaaccaccggccacacggcgcaggccgccgaggccggcagattgaagatgtccagactgaccccggccaagaaacagccgtagagcaccaccagcaccttgccgccgccggacaggcggtagaggccgtaggccagaaagacgacccagaccagggaggtgaactggttgccgacatagagcagcgaatggcgggccaggaaaaagcccaggcccacggccaggcaggccaaaccggcccggcgcgacggccaagtctccgggcggcgcaaggccagaaaacgcacggccaaaaaggccagggcggcatagaccgtgcccagcaggaaaaagggtccccagggcgtgaagcgcaggatcggcccccagaaccgcggcgaggcgtcggcccattcgacgacatcgtccaaaagacccatcacattggctggatgcagcagggaaccggcggattggagataggtctgtccgaagacggcgatgaaccggtcggtctcatcgttgcgtgcagcggcgatgtcggcggccagggcgtcggcctgggccagggcggcgtcgacgtcctccttgaccgcgtccacggtgtgcttgagttccttgaattcccggcccggaccggccagctcttcgtttatgagatcggcgtattcccggctggcgttctgggtcctgatctggcgcagggtggcgtattcctgtttggtgcgggccagggtgtcgcggatatcctccagggggccgcgagcctcgttgaccgccttgtcgagttcggccagctccatgagcagggtacgcgaggcccagggtgtgtcgccggccacgccgcgcagcagcaggagttggtccagccggctgctgacttgggacaggtccgttcccagagcattcttgatacccggcaaatctcggtgcaaccggtcgagttcctggcgcttgagcacaacgttttgcgacaacccgtcggcaatggaccgccacagctgttcctcgtccgtcgccgaggcccaggcggcctgccaaagaagagtcgtcagcagcaggccgatgatcccgaccgccgcttggattccagcgttattccagccccgacgccccatggcccaccccttatgtcgtatcggatttcccgcatggaaagtatcgcgcctggccggtctagcgcaaggccgacgttgacaaccggccctggccgccggccagggcggccggcccaggcttgcgctgccaggaccgggccggtatgaagcgggctgccaacgggagaggataccatgaaacgacttgttttcggcgtgattctgattctggccctggctggcggtgtagccggctacctgttcctggtcgacagggccaagccggagatcgcgctttcgccggatgccgccgtggccgcgcccaagcgcgagtttaccctgacgctacgcgacgccggctcgggactcaaaagcgccaaggtggtggtgcgccaggaggacaagcagatcaccctgctcgacgccgcttatgccacccccgtgcgcgaggccgtggagaaattcaccctggagccagccggccttcgcgacggcccctttactttgaccatcaccgcttccgaccgctccatcgccaatttcggcgcgggcaacgtggccaccgtcgaccggcagttcaccctggacaccatcccgccccgggtggacgtgacgagcctggcccacaacgtgcgccagggcggcgtcggggccgtgtcctttggcgtcagcgaaccggtggaaagcgccggcgtggtggtcggcgacgacttctacccggcctacaagctcgacaacggcaagtacttctgtctctacgtcttccccttcaacatggacccgaaaaacttcgtgcccaaggtcaaggtcacggaccaggccggcaatgtgggcatgggggcgtttcgcttccaggccatcccgcgcaagttccgcgacgacaagatcaacatctccgacgcgtttcttgagtcgaagatgccccagtactacaacatcatccccgacacccgggacaatctgcaaatctacctcaaggtcaacaacgacgtccgcaagcagaacgcggtgtttttaaaggaactggcccagaaaagcgccccggccatgctgtgggacaaaaaagccttcctgcgcctgcccaacgccgccccccgggccggtttcggcgaccaccggacctatttctaccaaggcaaggagatcgaccagcagacccacatgggcgtggatctggcttccctggaaggcgcggccgtgccggcggccaacagcggcaaggtggtcttcaccggttttctaggcatctacggcgaaaccgtcatcattgaccacggcctggggctgcaaacgctctattcccatctgcgccagatcgacgccaaggtcggccaggacgtgaaaaagggcgacctcatcggcaagaccggcgtcaccggcctggccgtcggcgaccatctgcacttcggcgtgttggtcggcggccgcgaggcctcgcccatcgaatggtgggatcagcactggatcgacgacaatatcctgagcaagttgtgaagctcctcgtgcaataggttcaaggccgtccggacataagtctggacggcctttttgtcggttcggaacagttgccgtcgtccctggcccgggcaaggcgacgcgccctggccgcgcggccaacagcgctcccgacccggcttgcggccaagcagaatgtttccgccccaggccgcaaccccggcctgccgggcacgccagcacgaaaaagcggcctccgacaatgtcggaggccgcttgcttgcgttgtttgccgccggcggcgaggcctgcccggctaccagctcttctgacgctgggcggccagggccacggcctgctcgtcgtagttctcgaaaccggcctggcgcagggcgtcgaacaccgtgcccggccagtcccaggtggcgtagagcaccggcttgtggaacagcttgcggaaggtctccatctcctgacggtagaaggcggccttggggctttccaggttctcgcgcaactgctcgccaagacgggtcagttcgccgtcgtaccaatccttgatgtcggcggcggtgtcgtacttcttggcgatgtgctcgtacttgttttgctgaagcacggtcttcaggcgcgccagatgctgctcgccaagccacgtgcccaggcccgaagccgggatgttctcgtcctcgacatgggccatgtcgaacttggtctggtagtaggtgtcgggcacaaccgatgcgcacacgatgccggcgatggcgaccaggccccgcaggatcacgctgttggatacgccctggccgcagaagcccacctttttgccgtacttctggccggcgaagatggtgaccagaagcgcccagaccacggccgggtcctcttcgtcgtaaatgtggcgcagtgccggattgtcgcggtcggtgccgagcaccatttgggtcatgtcgttggagccgatggagaaaccgtcgaactcctggatgaactgcttggccaggatggcgttgctggggatctcggacatgatgaacatcttgagtccatcgtcgcccgattggagcttgtgcacccgttcgaggtagcgcttcatggaaacggcttcttccacggtgcgcacaaagggcagcatgatgttcaggttcttgccgccgtagatgccgcgcgccagcttgaacgactcgatttcccagtcgtggatgttgcgcgacacgccacggtagccgagcatggggttgtcctccagggcctcgaagaggttgccgccaaggaggtttcggtactcattggatttgaaatccgtggtgcggtagagaatgggcttgccgtggaaggccatggcgaaaagccccaggccctgggacagggtctggacgtagagctccttgccgctgcggaagccgcgcgaggtgagctgcttgcggatcttgcccaaaagcgcgttgagatcatcgctttgggacttgatgccgacctgccgggccacttcctggcgcatggcggcgatcttggccagcacgtccttgaccagcggctcgtcggccacggcggccatgcggtcctcgatctgggccttgatctcgtagcgccgcttgacgtcgtcgggttccacggccttggtctggagctcgtcccagtaaccgagaatgatggccacatgggtaaacagatcagccgaagtcttgagcatgtccagacgacgggtggtcgcttcgagatagtggtcgagctttttttccaggtcgcggatgcggcggtgcacggccatgacttcgtcggtgccgcgcgcgccggagtggtcggccaggttgtccagctcggcggtcaggcccgtgatgaggccgacgtagccgcgcagcttgatctggacgttaatgaagccggcggccatctgctcgcgcacgaccttggccagcttggcgtcgagttccttgaccttggattcaatgagactcggcaaggtgccgttgtcgtaagcttccagggcctgggggtggacgccgatgttgccgagcatgaattcggcgcgcagcaggcccacctcgaagtcggggacattgcgcaggcgcgacaggaacagcgcctggcccacgtcggccaggatcaggccgaccttggtcttggtgaccggcagcttggacaggtccatctcgccgcccacttcgaccaggggcaaaaggccccggtagacgcagccgcgcgagccgtccacggtgacatactggccgtccagggagcgcagggtctcggcccgctggatgccgatgatggccggaatgccgagttcgcgggaggtgatggcggcgtggctggtgtcgccgccggcgtcggccaggatggccgaggccacgcgcatgcccggcaccatgtccgggtcggtgcgttcggcggccaggacgtcgcctttctggatcttgttgagttccagggcagagcgcaaaaagcgcaccatgccctggccggccccgcgcgaggcgccgttgccctcaaggatcacttcggccgaagcggcggcccgtttttcaacctccatgcggcgcatgaaaatggtgtcgggatgcagctccagctcgtcgttccaacgggtctcgggccgggcctggacgaaccacaggcggtcggactcgtcgatgcaaaattccgtgtccatgatgcagccgccgtaggcggccgagatggcgcgaacgccccgggccacttcctcggcctgggccagggacaaagcccagcggtaggcgatctcgtcgggcaccttgacgagcttggtgccgccctcctcgtcgtcatagacgatctttttgtccttgtagcccatgttgcggatgacgacctcggggccttcgtcgcgctggaagacaaaaagcttgtccggggtcaccatgccgccgaccacggcttcgccgaggccatagctggcgtcgatggagacaaggtcgttgcgggcggtgccgcggcagccggtggcggtgtcggcggcaaaggcggtgccggagatcacggggttgatcatgcgcatgatgcacacggacagcgacgtgttctcgatggcccattcctgcttggcgacttcggcgatggaatcgtcgccggtgcgctcggccagggccacggcgtcgaggatggcctcgcggcggtaggtcatggagcgcaagttgtaggccgaggcgcagtcccactggtaggcgcgcacgcactgggccgcgccgacgatgttgagataggtgtcctgcaggccggcgaaagctttcttgcggctgtcctcgccggcggccgaggagcgcacggccacgggcacgtcttccaggccggcttcgcggcaaatgtcgttgtaggcgctggccacggcctcgcgcacaccggccggcatgtccacggacaggatggcggcctgaacgaggacggaacgcttgcgcaactggtcgatgccttcgggggaggtggcgaagccctcgaccacgttgttgatgaacgtgcgcagcttgatggaggaacccggggcgtcggcggtcttgagacgagcctcctcggccagattacgcacgagatttttcatgtattccgggtcactgttgacttcctcgtcattccagtcgacccggcggtagccgtcgttgaccacttcacggatcagcgcggcgttgaccttggtttcgtcaaggacccgatggaaagccacggaggacacggcccggaattgcggggcgcggatgccctggatctggctgataagcgcggtgttatagtttttcccaccgaccagaatctcggcttcctcgccgatgccgacgatgtcggctccggtgagaataagcgtggcggcggtatcgagagccgcgccggtctcattggtggacgggttttcgtcctggcgcggtttgtcattggactggttcttggccatgctcccctccttgtctctccagactcgatgggccggcgtcttaccgccggccccactatgacacgttcgcggcaaaagttacattacatctgctggccgcaattcggacagaatttgaagccgtcgtcgcccaagggctggcggcaccccgggcaatccttggaaaccggggccagttcgaccaggagctccccttccttgaccggcaccatcttgcggtcgttggcgtaatcggcgtttttgagcactcgtttgaccgtggcgtcaaggggagcggccacggttttttcctgcttcatgacggagatgttgaacaattcctcgccggtcttgatgtagtcgttgggcgagacgtgcatgacccacaggtcgccggagaccggcgcgcccacgtggtaggggttattggggtcggccatctcgacctggctggccggcccgttctgggcggcggccacctggacctgatagctcaggatttccgaatccaggacatagcggacggtggccatgccgctgttgtccgggcgcgagatgtcgagcagggacaggtggtggggcttgccctggctgtcggcgaaggtcagctcctcgcccggctccagaccctcgaaccacacgtccaggggaaggttgttgggatcgccgaatttctttcgaaattccatggtcttgagcgcgtcgccggggtggttcaagtagagcacgaactcttcgttggacggctcgcggcccaactgcttggtcagggcggccatctcggcttccatgtccacctcgcccagggcgtccaggggcgaatcctcggtgcgcgaggcaatggcttccttccactccgagccaaaggcgctctcgtagacccagtcgggcgggaacccgagcggcatcttgccgaacttgcccaaaagcaggttgcggaaggcgtcgttgcagttggcgtacagcagcagccggtcgtgcttggccgccggggtcaggcactcgtcgcagttctcggacacggcctcaagcacttcgagcatgtccttgacggcccgttcgccgccgaccttgtaggcgctggtgacggccagaaacgccgtgttccaggtgatctgggaccccggggtgacgtcgtggtagcgcacgatcttgcgggtgccggccaggaacttgagcatgtagggcagcaggtggatgtagccctgcttcatggccccttcctgggaggagctggtggccccgccgggcatggcgtgttccaccacgtcgtagtcgatgccctggaaatagggcgcggtgtagcggtcgtagtagggcatgacctgcttgagcacgaagttggcggcccggatcatgtccttgttcgccttggtcagagccacgggcacgcccaggtcctcttcgatataggccgccgtggacagcacctcgccctggccgtaccagcgcacggaagcgccgatggcggtgtcgacgatgtggcagccggcttcggcggcggcgcccacggccgggacgaacagcccgtccgtgtagtggcggtggtagtcgacgaccagatcggggtaggccttgcggatggcggtaatcagctcgcgcacgaaacgcggcggacacatgccggccatatccttcaggcacaagatgatgctcttggccgccttggccttggtcatgccgccggccttggcggtctggtcgagaatggcctccagcacgccgaggtaatggggcacgtcgaagccccgggcgtaggacagggagatggccggctcgaagatgatgcccggccgcgacagggcgacctcggcaaatggatacatattgtcaatatgattgagaaaatcaaaacagcgaatgatgtcgtagtgctcgcagatcatctcgcccgtcagccgcatgaggttgcgcggttggggcttgtagcccagcacgttggtggagcggatgagcagctgcttcatggtcttgggcgcgaactcgttccacttggccgcctcggagaaggggtaggtcatgttggccatcatggccacgtggaagtgcgcgccgccgccgttttccagggagaagaagccgcagttgtcgagatacggcccgaccagctcatcctcggccagccggaagcggttgccgctgttggactgggtgatgtcgcgggtggtggtgtccacgaaatggaccttgccggagtcgcgcaccatgtccaggacggcctgacggtcgccgcgcggataggggctttccggcgaacgcagatcagcctcgggcatgtggggcgtgaagcgccccaggcggtagtcctcgcggccccggtacttgccgagctggacatgggggttgtagccccgggccgagacctcggccaccagccaggccaggcgcatggcctctgactcctcgtcctggtagttgagcagataggggttctgggtgatgaacttggtgtcgaaatcccctttcatgaactccggatggcgcagaatctggcggtggaacgggatcgtggtcttgagcccgccgatgatgtactcgcgcagcgcccgttccatgacggccacgaccttgggccagttgcggccgtaggaaataagcagcgccccggccgagtcgtactgggtggggaattcgtagccggccgtcaggcaggaatccagccggatgccctggccgcccggggacaggtagcgggtgaccgaaccagcgttgggggcgaagttctgcttggggtcctcgcagttgatgcgcagctgcatggcgtggaggaacggccgggtgtccacgcagttaaaacgcagcttgccgccgaaagcgatgttgatctgctcttcgaccaaatccacgccgtagcggcattcggtgatgccgtgctcgacctgcagccgggtgttgacctcgatgaggtacggctcgccgttggcgtcgaccagaaattcgaccgtcgccagcgaataatagccggtctcgcgcaccagccgctcgccgtagtccttgaggcgctggcgcagctcgtcggtcatgccgcgccagggcgacggcgtgatttccacgagcttttggtggttgcgctgcaccgagcagtcgcgttcgtcaaaggcgaacacgttgccgaagcggtcgccggccacctggatttcgatgtggcgcacgctggtcaagagcttttcaacgaaaagatgcgggttgccaaacgaggcctgggccatggccgaagccttggaaaaggcggattcgagctgggcttcggaataaatttcgtagatgccccggccgccgccgccgccctcggccttgagcatgatggggaagccgatttttttggcgatttcccgggcctcggggatggtgaccgagccttcggaaccgggcaccaccgggatgcccaggctcatggccagccggcgcacttcgaccttgttgcccaggcttttcatggcgtcggccgaggagccgatgaagatgatgccggcctcggcgcatttgcggggaaattcgcagtcttcggaggcaaatccccagcccggatggatggcgaccacgccccgggccttggctttcttgatgatgccgtcgatgtcgagataggcccggggatcggggcccagggtgatgagttcatgggcgccggcggtggccggggacgccatgtccacatcggttacggtgagcacgggaatggcgcgcaggcgttcgcggatggaacgcagcacccggcgggcggaaatgccccggttggcgacaagaatcttctttccttcaacctcggaaagcacttcctgaaacgtcttggcgatcatgctgtcctctgacccctgagggcgacctgtccattctcttttagagtgacgatccggcgggggccggcatcaaaggagggatatactcccgcaatgaagcgtcaaatcctgccctggcccggattcgccacgcagcagccgaagtcccccgtcctcggccaacccgacgatccgtgcccgaaacccgtccgatccgctctcgcgcacgaagacttcccggccaagccaagccagacgacgctcgacaaaacgggacaatgcactcgagtccgatagcgcaacgcactggaagtagcaggtttgcccaaacttcacaagttcgccccacaacgtaaccgcgcccggcacttcgccaaagtcggccaacgcggcggccggggcggcgtgatcccgacgaagcgacgccgcatccggggcctcggcgcagtttatgccgacgccggccacaatacggccatgtcgttcttcaaggaggattcccgcgaccttgcgcccctcgatcagaagatcgttgggccatttgaccgtggcggcgaatccccgggcatagagcgcatcggccagacaggccccgaccaccaccggggccatggcggcaagcgccccctccccggccggccaggacagggcggcgtagatgttgcccggcggcgaaatccattcccgacgcatctggccccggccgctggtctgggacacggcgacaaccgaggcaaaaggcggcagcaggccggcctcggcaaaggcccaggccgcgtccaggctcgtggcgcacgggccgacgaccaggatggccggagcgccggccagggccgggccttcgccgcgcagccagcgcccggccgccggcccatattcggcccccagctctaccgtccgccacggcccgagccgggccatgtcggcggcccacaaggggtgcccggcggccagaaatcccggtgaaaccggcccggccagacccggcccgcccgattcccacagccacacgccgccgctttcgaaggggttttgcgacaaggggcggctggcccctggatttttgacggcatttgggacaatgtccgcgccggagtcatgcatgaaacggtatctcgtaggcggcgcggtccgcgacatattgctcggccggccggttgtggatcaggattatctcattgtcgacgccacgcccgaggcgttcgtgagacggtatcgaagggctcggcaggtcggcaagacctttccggtcttcatgctgggcagcgcccagtacgcctggccgcgcggcgacagcgtggccgaggatctgctggcccgggacctgacgataaacgccatggccatgggcgattcccgggagatcgccgggcggctgcatttccaccccctggccctgtccgacctgcgcgaccggtggctgcgcccgtgcggcgagatgtccatgttcgacgatccgctgcgggtctaccgggcagcccggttcgccgcctcgttgccggatttttcgccccaccccgagcttgtggcccagatgcgggccgtggccgcctgcggcgtgctcggcgacgtctttgccgagcgggtggcccaggaagtgcgcaaggccctgggcacgaccaagccgtcacgctttttccagctcctggccgacaccggctgtttgctgccctggctgcccgaactcgaagccgcccgccacgtgccggccggcccgcccgagcaccacgacggcagcgtgtttgaccacatgctcgacatggtcgacatcctggccggcgacgccctggccggctggatggccgtgtgccatgacctgggcaagattgccacgcccgaatgcgaatggccgcgccaccacggccacgacgaccgtggcgaaggcgtggccggggaactcggccggcggctgaagcttcccaaccgggtgcgcgaggccggcgaggccgcggccaagctccacatgaaagccgcccgctatcacgaactgcgggccggcacgcgggtggacatgctcacctggctgcacaagcacgacatggtggaaccgcttttcgaggtggtgcgcgccgacagcggggccagcgtcctgccgcaagccaagcgcgacctcaaggtgatgctctcggtgcatctgcccggcaagcagcgccagcgcggtccgctttcgggcgagcggctgcgcaacctgcgctgccagaagctggccgagcacgacaaagcccagggccgcgcccccgaaggcgtggacggcgaacaagggcaggcccagggataggcctgggctggcccgcggcccgacctgaccagccggccgctacggcggcaaggagaagcccatggccctcgacctgaccagcctgaccaaggccatcgacgccctggatcggtcgctggccgccacggccgacggacttccagccatccccccgaacctgcgcgacacggtgcgggccggcatcatccagcatttcgtagtggcttacgatctgtgctggaaatttctccaacgctggctgcgggagaacgtctccccgaccgatgccgacttcccgcgcacccacaaggatctttttcgccaggcggcccgggccggcctgctcgacgaccccacaccctggttcggtttcggcgatgcccgcaacctgacctcccacacctatgacggcgaaaccaccctggacgtctgcgaggcggctcggcgcttcctgccccaggccaaggaactgctggcccggctggccgaccgcaatgattgacctcgccccggaccagctcgacaccgtgcgggccatcctggccgcccacctgcccgaggccacggttttcgtctttggttcgcgggcgcgcggcacggcacggccccactccgacctcgatctggccgtggcggccgacgcgcccctgcccctgggccggcttgaagccctgcgtgacgcctttgccgcctccaacctgcccatgcaggtcgacgtggtggattaccgggccgtctcgaccgcgtttcggcggatcatcgacgccaccaaagcccccttcgaatagcctcaacaggccggcgggagcatccatcgaccgccctgcccgcctcttgaaacagacgcaccacgtatcgccgataaaaaaacgccgggacggcgaccgtcccggcgtttcaatagcatcttcaggcgaagcctggcctcatagcagccagcgttgccggccgactcctccccctttaccctttttcccattcggggggtctgggggcctcaggcccccagccgccggaggcactcttcccttctcttttcgtctcgtctcgttgcttatcgcgtccgttcctaatgccgctgttccaggcgatattcttccttgagcagcgaatcggacaggggcgcggcattggcgtcgcggccgcagaacaggcgcgcctggtcctcgcaggccagggccttggacagcacctcgtccatgctttcgaccttgatcacttccatgtccttgaggatagcctcgggcacgtccttcaagtctttttcgttttccgccgggatgatgaccgtgcggataaggccccggtgggcggcgagcagcttctcgcgcaggccgccgatgggcagcacccggccgcgcagggtgatctcgccggtcatggcgatgtcgttgcgcaccgggaggtttaaaagcgccgagatcatggtggtggccagggtgatgccggccgacgggccgtctttcgggatagcgccctcgggcacgtggatatggatgtcgatttccttgtggaaatcaggcttgaggccatagagccccgagcgggagcgcaggtaggacagggccgcccgggccgactcctgcatgacgtcgccgagcttgccggtgatttcgaccttgcccgagccgggcatgatggccacttcgaccatgagcagctcgccgccgacctcggtgtaggccatgccggtgcacagcccgaccttgggcgcgggctccatctcgccgtggcggtgcttgggcacgccgaggtagccttcgagatcggccgtgtccacgacaaagccgccttcgggttccttgccctccacgagcttgcgggcggccttgcggcacacgctggcgatctcgcgttcgagattgcgcacgccggcttcccgggtgtagcggcggatgatggtcagcatggcctcgtcggtgagctggatattttccggagtcaggccgtgctgctcgatattcttgggcaacaggaaccggccgccgatctgcgccttttcggtttccaggtagccggggatgcggatgatctccatgcggtcctggagcggcagcgggatcgagtgcagggagttggccgtggtgatgaagaagatcttggacaggtcgtagtccagatcaagatagtggtcgctgtaggcgtagttctgctcgggatcaaggacttcgagcagggccgaggacggatcgccccggaaatccgtgctcatcttgtccacttcgtcgaggcaaaagaccgggttgttgaatttgacccgcttgagcgactggatgatcttgcccggcaacgccccgacataggtgcggcgatggccgcgaatctcggcctcgtcacgcacgccgcccagggacaggcgcacgaattcccgtcccatggcccgggcgatggatttggccagggacgtcttgccgacgcccggagggccgaccagacacaggataggacccttgatgcggtccaccagcttctgcacggccagatattccaaaatgcgttccttgggcttttccaggccgtagtggtcggtgttgaggatttcctcggcggccaggatgtcgagatcggtgtcctgatagacctgccagggcagatccaggatccattcgacatagttgcgcaccaccgtgtactcggccgaggacggcggggtctggcgcagctttttgatctcgcgcagggtcttttcccgggcttcctcgggcatgttcttttcttcgaggcgcttttcgaattcggccgcctcggccccgggatcgtcctcgcggcccatctctttgttgatggccttgatctgctcgtttaaatagtactctttctggttcttctccatctgctgcttgacgcggtttttaatccgcttctcgatggaggaaatttcgatctcgccctgcagaaacgcgtaggtttcttccaggcggcgcatgggctccagctcttccagcacgccctgcttcttgatgtagtccaccttgaggtggggcatgacggcgtcggccaggcgccccggcgaggtgatggaattaatcgccaggatggtttccggggccaacttcttgttgatgcggccgtagtgctccagggattcctgggtggcgcggatcaacgcgtcggattccggcccgtgggtttcttcctcgggcacgcggcgcacggtgaccatgggatagttggcgtcctcgcccatggtcatggtctcggattcccactcggcccggtaaagcccttcgaagagcaccttgatggtgccgtcgggcaggcgaagcatctggagaatcttgctcaccgtgcccatctcgaagaggtcctcggaggtgggtttttcggtctctggcgagcgctgggcgaccaggaagatcttcttgtcgtgggcggccacggcctgttcgatggccttgatggaggcttcgcggccgacaaaaaggggagctatggagcgcgggaacatcaccacttcccgcagactcatcatgggaagacgtatggtctcggcggcgaaccggttggaatcgaaggtaaatccagacatgcaacctcccgctgcggggttagtttccaggcccgcctccggaccgggcttgaacccgatccgaaggcctggcggcaggttgtgaggtaaggccggaaaacccgttgtcaatccgggcgcgacaagggcttcaggccgatttcacttcctgatgataaaacagcaacggttcgatgcccttttccaccacggctttgttgatcacgcactccttgacgccggtcagcgacggcagcttgtacatgatgtcgagcatgatggattccatgacgtttcgcaggccacgcgcgccggtcttgcgttcgatggccttctgggcgatggcgtccagggcgtttttggagaagcgcagccgtaccttgtccagctcgaaaagcttctggtactgcttgaccagggcgtttttcggctcggtgaggatgcgcaccagatcggtctgggtcagctcctcaaggctcgtgaggatggggatacggccgacgaactcggggatcaggccgaacttgatgaggtcggccggatgggcctgggtcagcagcttggacaggtcgtcgtcgctcttggcctccaccttggccccgaaacccatggccgaaccgcgctggcgctggcctacgatcttgtccaggccgatgaacgcgccgcccacgataaagaggatattggccgtgttgagccggataaactcctgctgcgggtgcttgcggccgcccttgggcgggatgttggcctcggtgccttcgatgatcttgagcagggcctgctgcacgccctcgcccgacacgtcgcgggtgatggacgggctgtcgcccttgcgcgcgatcttgtcgatctcgtcaatgtagatgatgcccttgctggccgactcgatgtcgtagtcggcgttttgcagcagctggacgaggatgttttccacgtcctcgcccacgtaaccggcttcggtcagcgtggtggcgtcggcgatggcaaagggcacgtttaagattctcgccagggtctgggccagcagcgtcttgcccgaaccggtggggccgatgagcaggatgttgctcttgtcgatctccacgtcgtcggcgccggcggaaccggcgtagtagacgcgcttgtagtggttgtgcacggccacggccaggatcttcttggcctgttcctgaccgatgacgtattcgtcaagcagccgcttgatttcggccgggggcagcagcttgccgccctcggtctcctcggtgacggactcctgggcgatgatttcgttgcaaagcgccacgcactcgtcgcagatgtagacgtccgggccggcgatgagccgctgcacttcgtcctggttcttgccgcaaaacgagcaacacagctcgcccgacacgcttcctttcttcctcgtcataccggaaatcccaccctgcccggcgtaccgggcctttttgaccgcgtcgcggccctcgtgcggcgtcctataagcaaatcagagggatctggtgaacaatcaccctgaaaaatggccttttcctgaaacaaacctgaccaatttttcaggaacaggccccaagggctattcagcgtcctttttctcaagccgttcccgggaggtcaacaccttgtcgatgaggccgtaggccacggcttcctcggcgctcatgaaattgtcgcgctcggtgtccacctggatgcgctccatgctctggccggtgtgcttggccatgatttcattgagggtttcccgggtgcgccgggtctccttggcgtggatctcgatgtccgtggcctggccctggtagccgccggagggctggtggatcatgatgcggctgtgcggcagggcgtagcgcatgccggtggcgccggcgcacaggagcagcgcgcccatgctggcggcctgtcccaggcacagggtggagaccggcggcatgacgtactgcatggtgtcgtagatggccagcccggccgaaacgacgccgccgggcgaattgatgtacatgaaaatttctttctcggggtcttcggactcgagaaacagaagctgggcgcagatcaagttggcgacgtagtcgtccacggcgctgccaagcaggatgatacggtcgcgcagcaaccgcgaatagatgtcataggcgcgttcggtgcgaccggtcgtctcgatgacaatgggtatcgtggccatctgcttcccttttgtaggccggaggcgacgttttgcgacgtttttgtcgtcaaatcgggaccgccacatccttccggcttcggttgccggacaaagcggccgctgcgacgcggccgctttgtcctggtttcattttcaatgcaagaagcggtcccgctccgtctagtcctgggcttcctcgccggccggcttttcgaccggggcgaccttggtcaccagggcgttggcgtagatcaggtccgccgccttgtcgcacagcagcttgtcgcgcaccatgatcatgaggccgttgtcctcatagtagcgcttgagcatgatgacgtcctggccggcctgggtcgagaggcggtagaagaacgcgtccatctcctggggagtgacggtcaattcttccttcagggccacggcggagaggaagatctgggtcttgaccagttcctcggcgcgcgggcgcatctcgccctggatgtcggccagggtcttgccggtggactccaggctcttgccccggcgctccagctgccccacgaattcctcgaccatctgtccgagctgctgctccacaacggcgggcggcagcgggaagtccagggtggccagcaggctgtccagcagcttcttctgggccgaggaccggtgcaggtcctcgcgggacttcttgtaggacatggtaatggcttcgcgcatcttgtccaggttttcgaagttgccggccttcttggccagctcgtcgtccaccggcggcagggtgcgttccttgatgacgtggacggccaccttcatggtgacggtgcggccggccagctcggtattgatgaagtcggccgggaaggtgacatccccttccccttcattgcccgaggcgatggtcttgaccaactcttcaaaggccggcagggcctggccttcgcccagggtcaattcgaaattctcggcccgaacgccggggatggccttgccgtcctcgaaggcctcgaaggtgacggacacgatttccccgtccttggccggacgattgtcgctcagcggcttcacttcggccagattcttgcgcacccgctcgatgacggattcgatgtcggcctcggagacgacgacgtcttcctcttccacggcctggcccttgtattcgggcagatcgaaggccggggcgtgctcgaagctgaaggtatattccaggggctcgcccttggtcagggccgcttcgctcacgtccaggccggagagcggcgacagcttgagttcgcccatgatctcgttgatgtgcacgttgatgaggtcggtggtggcttcgctgacgatctctttcttgaagcgctgctcgacgacgctggacggcaccttgcccttgcggaaacccttgaggtcggtccgggagcggaacatggccacggcggaagccagggcggcgttggcctcttcggccggcacggacacggtgacctgcgttttgacaggcgaaagctgattaacggtatattccaaggcatcctccaagatgttcgctggcgggcgggccgtcgcagcggattttcggtcgtattctggaaaaaatcgcaagcgaatacaaaatgggtcatgctacaggaagcacccccaaatgaaaagggcaaaatgccccgccaccggcggcggcggaccgcgccggaacatgggggcataggcgaggcggcgtcaaaaggcaatcaggaagacgcgccccagccgccgccgcccggcgtctggatgcacagcctgtccccggcccgcagccgcacatggaacttgcccggcatggccatgccgccggtactgcgcgtcaccacattgacgccggccgccccttccccgccgccgcaaaggccccaggggccgcgcagccgccggtcggagaggaccgtggcctccatgggacccagggcctcgatctcgcgcaccagcccctcgccgcccacatgccgccccggaccgccggaaccctgacgcagggcatagcgcgtcacgcggatggggtaggcgtattccagggcctccaccggagtgttgagggtgttggtcatgtgggagtggacggccgattgtcccgggccggccgcatcggctccggccccgccggccaacgtctcgtagtaggtgaagggtttgccgcttcgcggatcgacgccgcccatggccagattgttcatggtgccctgggaggcggccggtatgcggtcgggcagggcccgggacagggccagcaggatgacgtccaccagacgctgggaggtctcgacgttgccgccggccacggcggccgggaaacgggcgtcgacgagggttccggccttggtcgtgacgtcgatgggccgcaggcagccggcgttggccggcacggcctggccggccagggcgcggaacacatagagcgcggcggacacgacaatggcccgcacggcgtttatgcagccgggcgtttgcggatcgctgcgggaaaaatcgagttcggcccggccgccttcgacggtaagcgtcaggcgcagggtcggttcgttggttccggccccgtcgttgtccaggctgtcggccgcttcataggttccgtcggggatggcctcgatggcggcttgcatgaggcgttcggcgtaatcgagcagcgcggtacccatggcggccagccgttcgcggccgtaagcggcggccagcgcggtcagccgggcgatgccggtgcggttggccatgatctgggcggcgaagtcgccctggcgctcctggggcgtgcgcacgttggccaaaaacaggtccatgacgccctggacgatctcgccttcggccacgatcttgaccggcggtatgacgaggccttcctgaaagatggaggtggacagcggcatggagccggcggccatgccgccgacgtcggcgtggtgggcgcggcaggccacgtaaaataagggtgagtcgccgccggcatggacgggcgcgaccagggtgatgtcgggcagatgggtgccgccccggaagggatcgttgagcatgaccatgtcgcccggcccgaggtcgatggcgtcgatggcggcgcgcacggacagcggcatggagccgaggtgcacggggatatgggcggcctgggcgatcatgtcgccgccggaatcgaacacggcgcaggagaagtcgcggcgttccttgatattcggcgaataggcggtccgggtcagggcgacgcccatttcctcggccacggaagcgaatttgttcttgaagacttcgagggtgatcggggtgatgttcatggctgctccgtcccgtcaaccgttgcggcgcgcgccctggcgcgccagataggccgaaaaatccccactatacgccctactccccacatgggtgagcttgcccgccacgctcacatggactttcccgccgatgtcgcaccagcgtttgcaaaacgcataatcctcgggaagatagttgcgcgtctcggggtcgatcatggtgtcgaaaaacgcgaaattgtccgccgccggttcgttggtgcaggcaaagccgtagtgcagttccgggtaggccgccgccaactttaccagcacttcgcgccttatcagcatgaaccccgtggccgcgtactccacttccagaaacccttgcccgtccacctggcaaccgggtttgagcttcacggcataatccaggctggccgcctcggccgcggccggcggcgtgccggccggctgggccatgacccggtctagggcgagtcccttgaccggatagacgccgcagaccacgtccttgcccgaaccgagcagatgcggcacgagcagcggctcgaaggcgatgtcggcgtcgataaacagcagatgcgtggccgattcgtcgcgcaacacggcactcgcgatggagtttcgcgcccgggtgatgaggctctcgtggcagggggtgagcagccgaaacggcgtcctggcccggttgagcacgtcctttacgcccatcatggcgagcatgtacggcaccgtgaccatgccgccgaagcacggcgtgccgatgacgagcgtcacgccgtcgcggcccgcccgccgtccacgctgatgaccagattcccgaacccgtccacctcggcagccacccctggcggcaggaaggtggtggccgaggtctcggccaccagggccgggccggacaaggtgttgccgggcagcagtttgtcgcggtcgtaccacatggccgcctgctccgcgccctgccaaaccaggggtttccagcccagcatggcctcggccggcacgcccgccaccaaccgctcggcctcggtgaactgcggcttgtcggtgatgacccgggcgcggatgcgcagcgtcacgatctcgatgaccgccttgggatgcttgaagccgaagacggcctcgtggcggttgtggaaggccaaaaacgggtcggccacgaagcggatgggcagctcatgggactggccctggtagcgcatgtcgagctggcgttccaggaccatgcgcgcgcccggggcttcctcggccatgacctggcgcgcccgggtttcgagattgccgaaaagcccggccacctcgatgagatcggtcttgtccgaagcggccatgaccgtctcggaaaaatcgcgcacgatgtctgcgaaaagcatccccagggccgaaaaaaggcccggatggcgcggcacgaccaccgtcttgacgccaaggagccgggccagggacacggcgtgcagcccgccggccccgccgtaggacagcaaggcgaaatcggccggatcgtggccgcgttccacggaaatgacccggatggcccgctccatggccgcctcggccacggcgacgaccccctcggccgcctccacggcggtcaggccgccggccgcgcccagggccgtaaagagttccggcaagcggtcggggaaaagcggcatctggccgcccaggaaatggtccggggacagccggcccaaaaacaagttggcgtcggtgacggtgagcccgtcgcctttgccgtagcaggccgggccgggcacggctccggcgctctcggggccaacgaccaaggccccgccggcgtcgaggcgggccagggagccgccgcccgcgcccacggtatggatgtcgagcatgggcgtttttatgggcaacccggccagctcggtctcggcggccatggacagcgcgccgtcgagcagcgacacgtcggtggaggtgccgcccatgtcgaaggtgatgagccggtcaaagccggcggccttgcccatggccagtcccgcgaccacgccgccggccgggccggacagcaccgtgcgcaccggttcgcgccgggcggtctcggcccggatcaggccgccgctcgactgcatgacgcaaagctcggctccctcgggcaggccagcggccagatcgccgagatagccggccatgaccggggccacgtaggcgttggccacggtggtggcggcccgctcgtattcgcgaaattcggccaggatgtccgaggacagcgacaccgacagcccggcctcggccagggcctcgccaagaagcagctcatgctcgggcttgaggaacgaaaaaagcaggcacacggccacggactcggctcccgaggcggccacccgggccgtaagctcgcggacggcctcggcggaaagctcctcgatgaccttgccctcggcgctcacccgcccgggcgcgccgaagcgcaaggcctcgggcaccagacacggttccttgcggctggccagatcgtacagctcgggccggttctggcggccgatggcgatgatgtcctcaaagccctggttggtgacgaaggccgtgaccgcgccccggcgttcgagcagggcgttggtggccacggtggagccgtgcatgacgcgccgggccgggacagccagccgggcaaggcccgaaagcacggcccgggccggattgtccgggctcgacggcagtttgaccacggcaaaaccgtcgtccgtccagcagatgacatcggtaaacgtgccgccggtatccacgccgacaacggccatcgcgccccctttttccctttttgcaagggatggcagctacctggttgacgaaaatgcaatgcgtcccacgccacgaggcgtggaccagggaggcgcgctggcaaaaaaaatcgcgcgccgttcccgggcggctgggccatcccgggccgggcggaaccactattgcggatttccgatttttttcaaggggcaacgccgccgcgtcacgacgacgtgacggcgttgccatggaatcgaaaggaagaactacaggtttttggccagcagttcgccaaaggcggcgcagccgatggtggtcgcgcccggaatctggtcggccagatccacggtgacctttttctcggagatggtcttgtccatggagtcatggatgagtttggcggcctcgtgccagccgaggtgctccagcagcatggcgccgctcaggatcaggctgccggggttggccttgtccttgccggcgatgcccggggcggtgccgtgggtgggctcgaaaaaggccagcttctcggacatgttgacgcccggagccaggcccagcccgccgacctgggcggccagggcgtcggagatgtagtcgccgtttaaattcgtggtggcgatgacggaataatcctggggccgcatgagcgccacctggaacatgttgtcggcgatgcggtctttcaccacgatgggcttggtcccgccggccgccgcgtcctgctcggtcatgcactgggcggcgaattcctgggcggccacttcgtagccgaaggcccggaacgcgccttcggtgtatttcatgatgttgcccttgtggaccagggtgacgctgggctttttgtggtccacggcgtgctggatggccttgcgcaccagccgcttggagccggccggggtgatgggcttgatgccgatgccggcggtctcgtccaccttggctccgagttcgtcgcgcaggaacgcgatgagccgcttggcctcgggcgtgccggtggcgtactcgatgccggcgtagacgtcctcggtgttctcacggaagatgatcatgtccacgagatccgggcgcttgaccggcgattcgatgccctggaaatagcggatgggccggatgcaggcgtagaggtcgagcacctggcgcagggtgacgtttaagctgcggaaaccgccgccgaccggcgtgcccagcggtcccttgaaggccagctcggccgtggtcagggcctcgacggtggcctggggcaggtattccccgacttccttgaaggccttctcaccggcgagcagttccttccacacgagctttcgggctccgccgtaagccttgtccacggcggcgtcgagaaccggccgcccggccttccacacgtccgggccgatgccgtcgccctcgatccaaaataccgtcttttccatgcgcctgggctcctcttgggaaaatttaaacaaaaaaggaaaatagaaagggagccggtcatttgtcaaccggccgcccggccgccggcggccccggcggcccggggtccagaaaatgggccgcgaactgccgggccactcgccgttgccggtgttcgggcatggtccaaaactcggcgtcggccccacacagggccaggagctggactagtgccgcctcgcggccatcgcggtcaagggttggccagtcgggccgggccatgcgccgggcggcctcgccgcggcaggcgtcgacgtaacgcttgggaatgggggcctcggccggagcgcgcaggtccgggccgcccacagcccggggatcggtccggccgccctggcgcatgttgcccaaaagcggaaaatgcggcgacgggacaacctcccgcaacacgaaaagcagaccggcgaacaggaaaaaggccagcggaaccagcggttttcgatccatgacggacgtccccggccggtcggcggcggatgcgtccgtcaccgttgcccgcaccctgccccagtcccgtccccgacggctcgggaacggtccaagggggcaagcggactcgacgatcgctcccggcgcttcccggcggccgcccccagccggaaaaccggcccggcgcgggttgggagacatcccgcccgttacggctgcggggtctcggcggcgtagcgccgcagtttggcggtcacgttgtcctcgatccaatgcccgtcccaccattcgatgggaatgacgggctggcccgagaggtagaccgcaaaatgcacctgatcgcccggggtcaggcccgtggttccggtcgtgcccacgagttcgccctttttgagcacgtcgccgaccttgacggcgatggagccgaggttggcgtagaccgtcagaaggctcaggccgtggtccatgaccacggtgttgccgtagacgcccagaggcccggcaaagaccacgtccccggcgttggcggccgggacttgcgctcccggaaccgacgccaggccgatgccgtcgcttaattcacggccgatctcctggcccttgtaggtatagatgcggtcggccccgaaggacccgcgcaccacggaccggggcaggtagatgaagccgccgtcccacaagggctcggggccggacttggccgacagcgacccgatgaaagcggcgttttgccggcgcaactcggtgtttaactttttaaatcgttccaccggatcgcgctcctggggaaacagtccggcgaaggccggcagccgggcggccaggaaatcgtcggtgatctccacccgctcctcgcgaaaccgccgtttgatggccatattgacgaaaaatccggttttttcgttgccggcggcgtcctccacaaagagcctgggcttgtaggcctcggcatcgaggtcgctggggaaggcgaacaggcaggcatattggccgcttttttgcttgtagcccggaaagaaccgatcccccaccatcacgccgctgcgcgccacgtctttatttacttcatagacgaccagcccggctccgccctggcgcatgtagtgcgccggggtcaaggccttgatggtgggcggcacggggtcaagcagcatccgcttgttgacccgggcggcgttgccggccccgaggttggcgtgggagccgtcgtgggcggcgatctggatttcgaaggccccgccgcgcagttccgaatgctccaggctgaagcgttcgctgacctggtcgcggggcggatcgtagacccggcgcagcacgtcggcccggcgctggccctgggccacggtgacggtgagcgaccggatgccggactggtcgtcggaggcggtgaccacgaagggacgcttgagcgaggcggcctcggcctggggcgaaagcgtcacttgcggcttttcggcgtccttgaggaacagctgatagccggcgaacccggcgacgacgaccggcgaggccaggagtcccaaggccaggagccagaaggccggccccgtttttccgctttttttaaacggctttaaaatgcgcatggtgcaagtatcccctgtcgccgcagtggcgacactataggcgaggccggccggccgggcaagccgcccggcggcgaaacggagtttgcatggctgacgacgaaaaaacgaccaccgcaacgccgcccatcaaggggggcctttgcatggcggcggccacggccgccctggccgtgtcggccctggcgctcacccaggccggcgactggctgcgccgggccacgggcgagctgcgccacgaaaccgtgctcatggcccaggacgcggccatggcccggtccgaggcggccatggccgccggacttttcgccatcgatcccgaggagcgccgccggctgcgcctgacggccacggcctactgcccggaatgcctcgacgacgacgggccgcagctttcggcctcgggcgcgccggtgcgggccgggcgcacggtcgccgtctcccgcgacctgcgtcggctcctgggtcgcaaggtctatatcgaaggcgtgggcgtgcgggtggtggaagacctcatgcacccccgccatgccggccggttggatctgtgcctgcccaacaaacgccaggccgtggatttcggcgtgcaaaccctcgaagtggtgatcctcgactgaagccggccgccctgccctctcccgggcggccgtcccggctcccacatctgcctgggccggcccgtccccgccctcagtaggccccacgcatgctgcacaccaccggaatggtgcgcagcaaaatcttgaggtccaaggccaccgaccaggtgtccacgtactcgatgtccagctccatcatgcgctcgaagctcgtggcattgcgcccgctgatctgccacaggcaggtgatgccgggcttgacgccaaagcgccggcgcggccaggtcttttcgatgcgctccacgtcgcgaaggggcagcggccgggggccgaccaggctcatgtcaccgcgaaggacgtttatgagctggggcagttcgtcgatgcttgtgcgccgcagcagccggcccagaggcgtgacgcgcgggtcatttttgattttgaacagcgccccgtccatctcgttttgggcctcaagcgcctcctgcatgtccggggcgttctccaccatggtgcggaacttgtagaacatgaaccgccgctttcccagccccacccgctcctgggcgaaaatggccggaccaggcgaagtcagccgcaccaaagcccaggtcagggccagaagcggcgacagggcgaccagggcggtcagcgacacggacacgtccaggaaacgcttgagaatgcgctcgcgttcgtcggccaggctgctcgacaaggtggccaccacctcgccgccatggctgcccggccggctgccggggttgttgaggtcaaaaagcctcgccaccaccgtggccgtgacgccctgggcctcgcaggccgtgaccagccccgtgcccaggcggcttaactgcgcaagcggcaggcagatcaccacctcgtccaccacatgctcgcgcaaataatcagccagatcgtcgaagcggcagaccaaatgcgccgcctcgggctgggagccggctggagctacttcccagccgtcggccacgaagcccatgaagcgccggccctgttcgggatgggccagcatctcccgggcgatctcctgggcccgctccccggttccagccaccagcacccgacggcgcaacagcccctgggcctcgcccataaacagcagccggcgcagagccaggcgcgacgccacgcagcccagcgccgccatcagccaaaaagcggccaggaaaaccggcgtggccaggggcggacgcagggcggccgcgcctaaaagcaaggccatgaccacgccggtgacggacttgaccacctgtttgacggccaggcggcggtcatacagggcggtctcggtatagacgccgaaaaacggaaaaatgaccaacgtggcggccaggacgccaagcagcaggccaaggcttcccgggtccaggtgcagatgggcggcgctggccgtttccggggaaaaggccgtggagaccgccgccgcgacaacaagcgacagcgcggccagggccaggtcaagggcgcgaagccaggtgatggctccctgtcttgaggcgaagggcaaagggttcccccagcggttgcggctcggccacggcggccgggccagtcgtgacgcgcggtcccaaaacggcccggccccgcgcagtcacaaaggctactccatccgcaaggggatttgcaacctccgcgccattttcacgtctcgaccgcgataacgtcaaaggcgcgtttcgaggacacggccctagggcaccagcaacaccttgacgtcgcagacgttggtgttggtggggccggtcttgagcagccggcccacggcctcgaaatagtggtaggcgtcgttggccgccagataggcccgggcatcaagacccaggttctggccttcgcgcaggatggccaggctggcgaaggccccggtggcgtcggtggggccgtcggaaccgtcggtggaggcggccaggaacacggcctcctcggcgttgcggggttccccggccagcccggccagaaaggccagggccatttcctggttgcgcccgcccttgcccgggccgcgcagggtcacggtggtctcgccgccggcaatgaggcaggccggccggggcagcggtatggcgtattcggcgatgtccttggccacgccgagaaacaggttggccatctcgcgcgattcgccggccagatgcgaggtcaggaccagggtggcgtagcccagggcggcggccttgtcccgggcggccagcaaggcctggtaattggtgccgataagcaccgtgcgcacatgctcgaacaccgggtccccggccttgggcgtttccggggcgcgtccgtcggccacggccgagagcacggccaggacgtttttcccgattctctcccccacgccgtagcgctcgaccacggccagggcgtcggccccgcaggtggaatccggcacggtcgggccgctggcgatgacgtcgaggtcgtcgccgaccacgtcggataaaagcagccccaggcagtcggccggggcgatggccgcggccagccgcccgcctttgacggccgaaagctttttgcgcacgcagttgatttcgtggatggacgcgccgcaggccaaaagcgcccgggtggcggcctgcttgtcggccagcgtcaggggcaggccgggcaggtccaggggggcggcgagaatggccgaaccgccgcccgagaccaaaacgatgaccagatcgtccgggccggcttcccgcgccatggccaggacttcccgggccgccgcctcgccccgggcgtcgggcacgggatgggccgcctccaggagccggatgcgcgagagcgtttccaggtagccttccttgacggccaccaccccggccgtaatccgctcgccgagcaggcgctccagcccaagggccatgcggcccgaggccttgcccatgcccagaacgtagatgcgccggtagcgggccaggtcgtagacgtggcactcggtttcggtggtcacgcgcagggtgtcgcccgtgagcgtcaacacacgctgcatcatggccaggggatcgacccggtcgagtccggcccgaaagatggcttcggcgtcggcaaggggatttcgcatgagggggctccttcgcgccggcagggcgcagggtcatgcccgggagtgccagggccggccggggcgcgtcaagccatggcgaagcgagagcatggggtctggccgggcggcaaaagccggccggggatagccaaacgccccggcccggcgtatcgtggccggcaacgtcgacgccaggactgccgccggccaaacccgcgagacgcccatgcccaagcccgacctgaacctgctccccttttcccgggccgccctgagtcccgaattcgccccgggttcgcccgaccaggaccggccgggcgaacccggttgctggatcgtgctgcgcgaaaacgccctggtgctgaccgagggcagtttggccctgcccgacggcctgttgccggtccccggcccctttgccgtgccgccggtgctggtcggcttcttaaacggccgccccctgcgggccgcccgtctggaacccgaagcggccctgccggccggcttggctcccatcaccgcctcctaccgctcgccgctgctcgacgagcgacttctcaccctggccggcctggcccggcaggtgctccactggcgcgaccgcagccgcatctgcccggcctgcggaggcgccccggccggcatccccggcggattcggggcgcgctgcacggcctgcgcccgggaatactatccgcgcatccatccggccgtcattgtcctgatttcgcgcggcgacgactatctgctggtgcgcaaggccggctggccggccggccagtacggattggtggccgggttcgtggaattctccgaatccttcgaggagtgcgtggtcagggaagtggccgaggaaaccgggctggccgtggccggcatccgctacctcggcagccagaactggcccttccccagccagatcatggccgcgttcgcggcggactgcgtcggcggcgaactcgtggtcgaccgcaccgagcttgaggacgcgggctggttttccgcccgccgcccgccggccgtgctgccgcccaaggccagcatcgcccgatggatgctcgaccgccacgccccggacctggtccgcgccgccggcggcgcgtaaaaagtcctccagatcggcgggttattcgttgacagggcgggcgggcttttatataggatcaatcagctccgattaatccacaagagaggcgtttcatgcgtttgacccgagccggcgagtacgccatccgctgtgtcctgtacctggccatgcaccaggaccggacgctcattgggcgcaaggaaatcgccgaggccatggacattccggcccagttcctgggcaaggtcgcccagcaattggccaaggccggggtcatcagcatccgccagggttctctgggaggctacgaactggcccgccggccccaggacatcaccctgctggccgtcatcgaggccatcgacggcgagatctttttaaatgattgcatccagcggcccggcagctgcgacaggcaggccatctgttccgtgcataacgtgtgggatacggcgcggcggcaattgcgcgacaccctgggcagcaccaccctggccgagttggcggccttggaaaagtgcgcttgccgggggcagtcgtgtgaggggccgcgcgcttcgaatggttgagtttttttgacgggggttggtgcatttttcccggggcggtgctaggtggaaatcgaccgccggcttgccgcgccttgcggccgggaaaatgcgaaacgggtttgacggtcaacacggaggaaaaggagacagatcatggacaccttgatgctttcccgactgcagttcgcctttgcgacatttatccacttcatcttcgtcccgctcacccttgggctttccatcatcgtggccatgatggaaaccaagtacgtgcgcaccggggacgaaacctacaaacgcatggccaagttctggggcaaactgtttctgatcaacttcgccctgggcgtggtcaccggcatcaccctggagttccagttcggtaccaactggtcgcgctattcgacctttgtcggcgatattttcgggtcgcttttagccatcgaagccacggcggcctttttcttggaatccacctttcttggcgtgtggatcttcggttggaaccggctttcgcccaaactccactgcacgtccatctggctggtggcctgcgccgccaacttctcggccctgtggatcatcctggccaacggcttcatgcagcaccccgtgggctacgttatccgcaacggccgggccgaactgtcgagctttcttgaggtcatcaccaacccctacggctggaacgcctttctccacaccgtcaccggctcctgggccctggccggctttttcgtgatcggcgtgtccgcctggcatctgctgcgcaagcagcatgtggacttcttcaccaagtccttccgcatcgccgccggcttcgccctggtttccaccctgctcgtggccgccgtgggccaccgccagggcaacatcgtggccgaagtccagccggccaagctggcggccatggaatcccattgggagacccagaaaaacgcccccatgtacctctttgccgtgcccgatccggacaatgagaaaaacagcatcgagatcggcggcatcccgagcttactgagcctcatggccttcaacgaccccgccgccgaagtgaagggcctcaaggacttcccggccgaagaccgtccgcccgtcacgctcaccttctccgccttccgcatcatggtgggcctgggaacggccatgctgatcctggccgtgctggcctttattgcccgccaccatcccgaggaagcctcccataagctcttgaaggttttcctgtggaccatccccctgccctacatcgcgctccaggccggctgggccgtggccgaggtcggccgccagccctggatcgtctacggcatcatgcggaccaaggacgccgtctcccccattgccgcccatcaggtcggcatcagcctggccgccttcttcgtggtctacatcctgctggcgtcgctggatatctatctgctggccaagtacgcccgctccgaaccgcactaggcccggacaccaccgcgtcatggcaatgcgactgactcaacccggcccggccggttgctaatcgaaggagacagaccatggatctcggaaccatctggtttatcctgtggggcgtgctttgggccgtctatttcatcctggacggattcgacctcggcatcggcagcatcatgccgtttttcgccaagtccaacgaagaaaaacgcatcatgtacaacgccatgggtcccttctgggacggcaacgaagtgtggctcatcaccgccggcggcgtgaccttcgccgctttccccaagacctacgccgtcatgttctcggcgctctacacgccgctgatgctgctgctgttcgcgctcattttgcgaggcgtgtcctttgaattccgctccaagatcgacagcccgggctggcgcaagctctgggacacctgcaacttcctgggcagcttcctgccggccttgctccttggcgtggcctttgccaacatcttcaagggcatccccatcgaccaggacggcatcctgcacggcaacctcttaacgctccttaacccctacggtctggccggcggcctgctcttcgtcgccctgttcgcccaccacggcgcgctgtggctggcgttcaagtccgaaggcgacatccatgaccgggccgtggccctggccggcaagctctggccggtggtggccgggctggtggtgctgttcctggtcatgagccttatgatgacccagctcttcgccaactacctggtcaatccgctgctgtttatcatcctgctggtggccgtggccggactggtcctgaccatgacctaccgcaaggccggccgcatcctggcttcctggggcgcttcggccgtgctcatcggctcggccgcccttttcggcgtggtcggcatcttcccggccctgctgccgtcgagcctcaatccggcctattccctgaccatccagaactcctcgtccacgcccatgacgctggccatcatgctcggcgtggccctggtcttcgtgcccatcgtcatcgcctaccagatctggaccatgcgcaccttcagccaccccgtgaccaaggccgacctggactacgaagaagcttactaagatactaattttcaataccaaatgccggcgaagcgcgcttcgccggcattttttttcgccttggccaaatcggtgaaacagcggaaacactgtttttatttattgacaacgagaatcaacatcagtaccactacttttcggcttgcgattgttaccgaattgtcacattgcgggataggaacggagatgccgtccacaacgcaacccacttaaggaaggagacgcacccatgaacgattatctgaaaaacggactgttcctggccgctggagtcgccatcggcgccctgggcgcggtggcccttggcaaaggcaaattctcgatccgtccggccatggccgacctgctgtcccacggcatggacctcaaggaaaagaccgccacggttctggagcgggccaaggaaaacctcgacgacctcatggccgaagccaaacacgccaaggaatcccgggagggcaaatccgtggccgaaggcgaaacggcctaaagacccccttgccgggtggagtttcaacgcatgacgcactgcgccattgtccacgatataccgggtcggatgcggctgcggttcgcctgcgccgaagccttttcggcgcaggctccggccctggccgccgccgccgtatctttgtccggcgtggccgaggtgatcccctcgcctcggaccctcggcctgctggttctttacagcggagacccggtgcggctggcccttttggccatgaccaaaaacggcgactcggccaaatcggccatgctcacccccgcgccccgacgccggggcaaggcggtccgggccgtacggctcggcaaggtcgccctggccaaggccggcgacaaactcgccaaggccgtcaacctcccggccgaggccggggacaatcccccctcgcccttgcaggccatggcccgcgaggccgggatgttcctgctacgcgccgcgttgccgccggcctttcggccgctgtttcttatcaagcgcgtctggcccttcatcaagcgcggcctgggggcgcttgtgcgcggcaagctcaacgtcgaggtcctcgacgccctggccatcggcgtgtccattgcccgcaaggactaccgggccgccaccggcatcgccctgctgctggggcttggcgaggtgctcgaaagctacacccgcaagcgctcccgtgagagcctggccgaaaccctggccgcctccttcgacgccgtctgggtgcgccgccaggacggcccggtgcgcgtggccgcctcggaagtcgtgcccggcgatctggccatcgtcaccatgggcaacgccattcccgtggacggcgtggtggccgagggcgaggccatggtgaaccaggcctccatgaccggcgaacccctgcccgcccacaagcgcgtggggcatacggtctttgccggcacggtggtcgaggaaggcgagatcgtcgtacgggtggaaaaatccggcggcgagacccgcatccaaaaaatggtggaagtcatcgaggaatcggagaactacaaggccaaggcccaggatctggccgaacgcttcgccgacgccgtggtgccctggaccctgctcggcgcggccgtggtcttcgcgatcacccgcaacccgcgcctggcctcggccgtgctgctggtggacttctcctgcgccataaagctctcggcccccctggccgtgctggccgccatgcgcgaggccgctgccggcggcgtgctggtcaagggcggcaagttcctggaaggcgtgtcctcggccgacgcctttgtcttcgacaagaccggcacgctgacccaggcccgcccccgggtggccgccgtggaacccttaaacggctacacccgccacgatgtcctcaagctcgccgcctgcctggaggagcacttcccccacccggtggcccgggccgtggtgcgccaggccgagaaggaaggcatcgtccaccaggagttccacgccgaggtggactacatcctggcccacggcctgtcctccatggtcggcacggaccgggtgcgcctgggcagccgccacttcatcggcgaggacgaaggcatcgacatcgccgccgccgacgcggccatcgaagcccggggcctggccggcctgtccaccctttatctggccatcggcgacgaagtggccggcgtgctggccatcgaggacccgctcgttcccgaagccccgcgcgtgctgcgcgaactgaccgaccggggggttacgcgtctggtcatactcaccggcgacgccgccgccccggccgccatcgcggcccgggagctgggcatcaccgactaccatgcccaggtgctgcccgaggacaagacccgcatcgtgcgggagctgcgcgaggccggccacgtggtggccatggtcggcgacggcatcaacgattcgccggccctgtctgccgccaatgtcggcatcgccccgcgccacggtgcggacatcgcccaggccgcggccgacatcctgctggccgagggcagcctgcaaagcgtggtggccctgcgcgacatcgccaccggcctcatgggccggctgcatgccaacttccgagccatctgccttatcaattccgtgatcctgggcctggggcttttcggccgcgtcaccccgggcgtctcggccctggcccacaatctggccaccgtgggcatcgccctggccagcctgcggccctatctccccaaacacctgccaagcggaggcgtcagccatgatagccagctgcattgaaggccgcatccggttccggcatccggccctgtccgatccggaactgcttgaaatcgtcaccagccaactcgccgccatgcccggcatcaccgagatagaggccaatccccgcactggcagcgtgctcgtcagccatgacgcgtccgtggccaccagcgacctcgtggccatggccgaggccctggccgccacccacgccgaagccttggcctcggccgcgccggccaaaccggccaaaaaacgcatgactccggcccagctcaagcgccgcacccagaagatcggcttggccacctgcatggccggagccgtggccacgggcctggccgacaccaaggccgcccacctgaccttcggtttcgccctggccggcttcgccgcctggcacctcaccatgcaccggcggcggtttctggcctgagccccggccgtcctgccctatgaccatgttcaaaagcccgctgcacgaatcgcgcggcctgttggacgtcgtcgtgccccacacggtgtgcggcgacgtccttttagccctggtccatcaactggccgaatccctgggccgggccatcgacgccaaggactcccacaccatggcccactccgaggaggtggccgaggtgtcgaaattcctggccgccgccatgggcctgtcccgggagagcgtcgcctgcgtccacgtggccggccatctccacgacatcggcaaaatcggcgtgcccgacgccgtcctgggcaagcccggccgcctggaacccgacgaatggcagcgtatgcaggcccatccggccatcggcgcggacatcctcgacccgctggattgcctggcccgcaccggcatcgtggaaatggtgcgcgcccatcatgaacgcttcgacggctcgggctatcccgccggtctcaaaggccgggagattccccttggcgcacgcataataagcgtcgccgacagcctgtcggccatgctccagacccggccctaccggccggccatgggctttgccgaggcccaccgggagatcgcgcgctgcgccggcagccagttcgaccccgatgtggtggacgccttcctggccgtggccgatgaggtgcgtcagcttctgggttcctgccggggcggcgtcttggtgccctgaagacgcggccaaggcaaagcgatacggggacggccgactggcccccgctcctgggcggcggcagacatttcgggacataatgataacgacttttcaaatcatttaactgatcttgcttccaggccaccgtcatcggaagcccttcaaccacgcggaaacgggaaggagtgtcgctcatgcgaaaaacggtcgcgttgctggccctggccattgtggccgccacggcggtcccggcctggtcggccacggaagtcaaaatggccggggatgcccgggtgtacggcgtctttttcgccaatcgcaatttcaccggctgggacgagaccggaacccagaccgaggaccggctcaccatctggcagcgcctgcgtctgcgggccgatttcgcggccaatgagaatctcaaattccgcttcgggatgcgcgtggatgacgaggcctggggccatgactacctcaccgccgccaatccgcaagtggccatccagccctacctggcctacctccagttcaaatggccgggcacggacatcgaggtgacggccggctaccagcccttttccgtgccccagaccgaggtcttctacgacagcatcgtgctggccgccgacgacggcgaccagtccagcgccgcgctgttcgtaaaaatcccggtcatcgacgacgtgttgaccatcgaagccgcctacggccggctactggacgcctaccgcacctaccagcccaccaccacccaggtgggcgacgccttcgacgtctaccgcctggccctgcccttcaccgtggacggcttcgaggccacgccctggggcctggtcggcgtgtacggcaaggaggccgatcccgaaggctacttcgacgccggcctgcgctcggccggcagctacctcgatcccgccggctacaaggacaaccagaatcccatgtggtggggcggcctagccctttccgtcaccgccctggacccggtgaagctctatttcgacggcatctacggcaacgccgccggttcggatcggtcgcgaaaccgccgcgaaggctatttcctcgacgccggcctgacctacacgggcctcgactgggccaccccgggccttttcggctggctggccagcggcgaggacgggagcctggccaacggcagcgaacgcctgcccgtcatcgcccccaaatggggaccgggcacctcgttcctgtttgactgcgaccaggagttcgccaacaactccatgggcatcaatccgctgggttcctggggcctggccttggccgtgcgtgacatctcgtttatcgatgccctcaaaagccggctgaccgccgccgtcatggccggccgcaacagcccggccgggctgcgcaaggccgtctgggccaccggcggccccggcgagtatgtgaccatgggccgcgacctggcccagggcgaatgggtgtttggcctcaacttcgaccacagctacgagctgaccgaagccttgacgctgaccctgcaaaccggcttcgcctcgccccaggggcttaagaccagcatctggggccaccgcatgaccaaccaggccaccgacgcctggatggcttccctggggttcctgtacaccttctagtccttggagccgggccacggtcgtggcccggctccaaggaccgccgtttgcttgccgcgcccggccaggatgccgccatcctggccgggcgttgttgttgccaggccccggtcgcccgccgcgacaggggcacaaggcccggacgtctgtcgacgcctggacgcctgaacgccgccatgctaggaagacgacgggaaccgaccgtatccggcgcatagccaaaggccgcccggtcggcctgccggccaggcccagcctgcccgccccgcaaacagaccgccagcaaggtgctccatgacgccgacccttcgattccgcctggccaggggatgcaccctggctgtgtgcctgctcggtttgctcctgctcctgccgggcaggattgcggctgccccgccgcaaggaacgccggccgcgtccaaggcccagccggccacggacgaaaccgtggagaccgtggccgccccggacgatacggccaaaaccatcagcatcaatttcgacggcgtggacctgcgcgctttcatcaagtatatcagccaggtaaccggcaagaatttcgttattgacgacgccgtcaaaggcaacgtcaccgtcatctcccccaagcccctgtctccggccgaagtctacaaggttttcgagtccgtccttgaggtcaacggctacaccgccctgcccaccgagaacttcgtcaagatcgtgccggccaagaccagccgggcccggtccatgccggtcatcgacggccgcgagaccgtgaccaacccggccgacgccgtggtcacccaaatcctgcccctgcaaaacatccgggccggcgaactgcgcaagaccctggcccccctggtctccccggacgggatgctggccgattttgccgacaccaacgcgctgatcgtcaccgactaccggcccaacatccagcgcatcatcggcatcgtggaccagctcgacctgtcctcggccaaggccaccctgcacctgtttcatttgaagcacgcctcggccgccaagatctcccagaagctcgaaaagctcctcagccagagcgcggccaaggaaggcggcggccagaccaagatcagcgtggtccccgaggagcgcaccaacgccgttatcgtcctggccgaaccccagtacgtggcccaggtcaagggcctgctggccaagctcgacgtgcccaatcccatggaacagggcaacctgcacgtctacaagctccagcacgccgatgccgagaacttgagcaaagtgctcaacgaactgttcaccaagggttccacggccacgggcgacgcggccaaggcccaagccccgacagtctcgggcgggtttaatttcgtggccgacaagtccaccaacagcctgctcgtcaccgccgcccccgaggatttcgccttcgtcgaccaggtggtcaagaagctcgacgccccgcgcaagcaggtctacgtcgaggcgctcatcatggaagtctccaccgacaaatcggtgtcctttggcgtcaacctcaacgtggccaacaagcagtccggcctgggcgacggcaaatacggcgggctgctttttgcttcatccaacccggccggctacgagtcgctgtataattcctccggggccttcgtgcccccggccggcggctcgctgggaggcttggccttcccggtcaagatcggcgaggtcatctattccaacctgcaagccatgatcaacgcctccaaatccgacaacagcttcaacatcatcgccacgccacagctcatgaccctggacaatgaggaggccaccatcaccgtggccgaaaaccggccctatctgacgagccaggacgtgggccagtccaccactgaccggccctaccagcgcttcgactacaaggacgtcggcaccacgctgaaggtcacgccccagatcaacgaaggcgattccatcaagctcaaggtcaagcaggaaaccagccgcatcgacgagacggtcaccaaggaaaccggcgcgctccagccgaccacccgcaaacgcgtcaccgaaaccaccatcatgtgccgtaacggcgagaccatcgtgctctccgggcttatcggcaagagccgggccgagggcaacagcaaggtcccgggccttggcgacgtgccggtggtgggctggctttttaaaaacaagtccgtggccgacgagcgcaccaacctttacgtctttattaccccgcgcatcaccgcgcccggggtggacagcgaccggctgctgcacgccaaaaaaatggaaatcgagcgccagatcgaattcaacgaagaggagctgtccaagcccatccgcaaggccccggtctttttcgccgccggagccggcaaatagcatggacaggctgccggatttccggcgcatggcccaccgtctggccgccctgtgccggctgcccctggcccggggcggccgcgtcgcggcgggccaagcgacgcccggcccgccgcggccatcgctcttagagcccatggccgaaaccctggccctgcccctggccgccctggaagacgcttttaccgaggccgcccgggccggccaaaatcccttcaagcgcctggccgaactccacaaggtcgacgcggggctggccgcctcggccctggccgccagcctcggtctgccctatctcgaagccatcgacgtcagcgacgaggacgccgagcgcatccgccgactgccttttggctatctcaagcgcaatctggccgtaccggttgccctggacggccggcagcttgtggtcctggccgatcccttcgcgccggagctggccgatgacctgcgccggctgctcggccagcccgatctcgccgtggccctggccctgcccgagaccatcgtttcggccatcaaccacgcccacggcgaagccgagggcgagcgcgaccccaggctcgacaacctgagcctggacgatttcatggggccgccgccggagaacatgtccaccgaggacctcctggacgagaccagcaacgccccggtcatccggctggtcaaccagctcctggcccaggccgtgcgcgacctgtgcagcgacatccacatcgagccctaccagaattcgctgaaaatccgcttccgcctcgacggcgtgctctacgacatcaagaccctggacaagcgctggcatccgcccgtcgtgtcccacgtcaagatccgctccaagctcgacatcgccgagcgccgcctgccccaggacggcagcttcgacatccgcctgggcaaccgcaacgtggacatccgggtgtcggtgtttcccaccaagttcggcgaacggctcgtgctgcggctgctggaaaaaaacagccgcatcctgagccttggcgaactggggctttcccccggccatttcgaggaactaagcgccctggccaggctcccccacggcatcatcctggtcaccggccccaccggctcgggcaagtccaccaccctctacgcgctcataaaccacatcaattccacggacaaaaacatcctcaccatcgaggacccggtggaataccagatcgagggcgtggggcagatgcaggtcaacgccaagatcgacctgacctttgccggcggcctgcgctcgattctgcgccaggacccggacgtcatcctggtcggcgaaatccgcgacaccgaaacggcgcaaatcgcctgccaggcggcgctcaccggccacctcgtcttttcgaccctgcacaccaacgacgccgcctcggccgtcacccgcatggtggacatgggcatcgaaccctacatggtctgctcggtggtgcgggcgctcatcgcccagcgcctggtgcgggtcctgtgcccacactgcaaggaagccttcgtgcccaccgaggaagacctgctgccctttggccccggcgcggccgccctggccggccggagcttttgccgggccgtgggctgccctcagtgcatgggcacaggctaccgaggccgcacctccatccacgaactcctggtcatcgacgaagccatggccgaactgatcctgcacaatcccgaagccggccgcatccgcgccgcggccatggccgccggcatggccaccctgcgccaggacggcatggacaaaatcctgcggcatatcacgaccatggaagaggtcatacgggccacggtggtctgaggccgcagtctcttgacagggatttggcgtcgatatatgtccgcccatcccgtcgcgggattggtcttgacagcttgtgaaccggtgttaacttccccccatggctgaacgtctggaatcccccctgcgccgcgaacagatcgccgaagccgccctggacattgtcgtgcgccagggcatcggcgccgtgaccgtgcgccgcgtggccgaagccgtgggcatctcggccgccgccctctatcgtcactacaaaagcaaggtcgacatcctggccgccgtcatgcacgagcaccaggaattcttcatggccacggtgcgcacggccaaggccgagtcgacgagtccgctggacgcgatccgccggctgtaccactcttccatggtcatggtcagccgctattgcgccttgcccgtcgtctttttgtccgatgtattgtggttcgaggaaccggagttgcgcgccctcaaactgcaacatcacaaaatgctgcgggacatcgtcgtggaattgattatcgctggccagcaggccggcgaaatccgcactgatctgcgcccggaagaaatcgtgatccatttcctcgggcttatcgccatgccggcgcttatccaggcacgcacgccggaagatctggacatgccccgccagatcacggccaactgggagttgttcgcccatgccgttgctccatgattttttttgccccaaaagtgaacacgcgttaacgccccacaccatgccgctccatcgtctgaccctgggtcttgcaggtctggtcgccctggccgtgttggccgggcgggccgtctccgatgcgcccgcgcccactccggcccggcgcaccctggccgccgtccaggaccactatgccggacggttgcccaattcgccggaaaccggggagctggccgtctacgccggcgcacccggcgagccgcccctggactgcgccgctctggccaaggaccggaccatggtcgccctggtctttggccagtccaacgcctccaacaccgtggacccgggctacgagtccgtccagccagtctacgcctttgccgacggcgtatgcaccaaggcccgcgacgccctgcccggggccactggaaccaagggcagctcctggccgcgcctgggcgacaagctcattgccggcggcttttacgacgccgtcattttcgccaacatcgcccggggcggctcctccattctcgaatggggaccgggcggccgccacaacgccgtgctcctggcctccctggattccctggccaaggccgggctggcgcccacccatgtgcttttccaccagggcgaggccgactgcgccctgggcgtggccgggccagactacgccgacatgctcgccgccgtcatcgaccagattcgaagcaaggtcgggccggcccccgacgtcgtcgtggcccgaacctcccagtatttcgacctggtctgcggcgacgcggccaatccggcctgcttcaagacctgtccggccttgatccaggcgcaaaccgccgcggccgacccgcagcgccatgtcctgtccggcccggacaccgaccgcctcgtgccctactccgaccgcaacgacggctaccatttcacggcccaggccgccgaccgcttcgccgaggcctggctgcctctgctcgcccgaagcgaggccgccacaagccgcctgcaatgaacccgcaacccttttcgcccgcaaccggccgtcgccatgcgcgcgacagccgcctgtcccggagggaatcatgactgtctccattttcgccaaggccgcgcgcgtcaccttcgccatgtgcctgccttttgccctggccgccgccctgtccggctgcgccaccgaaagctcgggccaggaaaacgccgccgcgccgccgccgccggaaatcgtggcctacgccgtcaagcaggccgacattcccctggaaatggccttcatgggccagaccgccggctcccgcgaggtcgaggtccgggccagagtgggcggcattttgctgcgccgcgactatgaggaaggctcacgcgtgcgccagggccaactcatgttcgagatcgacccggccccctaccaggccgccctggaacaggccaagggcgccctggcccaggccgaggccagcctggcccaggccaagcgcgacgccgaacgcatggacaagcttttcaagggcgacgtggtggcccgcaaggacttcgacgattccaagaccgctgtggaaaccggcaccgccgccgtggatgcggccaagggcaaggtccgcgaagcttcgctcaatctcgaatggaccaaggtcacggcccccatttccggcatgaccagcaaggagacccgttccgaaggcagcctcgtcaccaccggttccgacggcagcctgctcaccaccatgtcccgggtcgatcccatctatgtgaacttctccatgtccggccaggagatgatgaagattcgcaagctgcgggccgagggcaaggtggtcgtggacggcggcgatttcactgtgggcctgaccctgcccgacgggtcgtcgtatcccctcaagggccgcatcaatttcaccgacacccaggtcgacgccacaaccggcgtggtcaaggtcagggccgaattccagaaccctgacgggtcggtgctgcccggccagttcgtgcgggtgcgccttgagggcgcgcgcttcaaggacgtgctggccgtgccccagggcgctgtgctcaacacccagatgggggccatggtctggacgctggatgacaagaaccaggtcgccccgcgcccggtggtcctcggcgaggccgtgggcaacgactacctggttgagcagggccttggggccggcgagcgcatcatcgccgaaggcgtgatcaaggtgcgcccgggcctgaccgtgcgcgtgcgcggtgaagaacccaagcaggcccagccggccgccacggcccagaccgctccgcaacaggctcccaaggacgccccggccgccgcccagaacggcgaggccgccaaggccgaggtcaaggagaaccgttcatgatttcacgctttttcctgggccgcccggtcttttccatcgtcatctcgctggtcatcgtgctggcgggtctggcggccatcagaagcctgcccatcgcccagtacccggatatcgtgccgccagaggtcaacgtcacggccgtctaccccggggccagccccgaggtcatcgccgccaccgtggccgcgcccctggagcagcagataaacggcgttgacaacatgctctatatgcgctcgacgagctccggcgacggcacgctgtccatcaccgtcaccttcgccgtcggcaccaaccccgaccagaacaccatcaacgtcaacaaccgcgtccaggcggcccagaccaccctgcccgaggaagtccgccgccagggcgtgaccgtcaccaaaaaatcctccaacatcctccagatcatcggcttcgattccccgtccggccgctacgatgcggtgttcatcagcaactacgtgctggtcaacatccttgacgagctaaagcgcctgcccggcgtcggcgacgcctccatcttcggggccaaggactattccatgcgcgtctggctgcggccggacaagctggcccagctcaagctcacgccgaccgacgtggccaatgcgatcagcgaacagaacgcccagttcgcggccggccgcatcggggccgagcccaccaagcccgaaagcccggtggcgctcaactacatggtcaccaccaagggccggctcatcacccccgaggaattcggcgacatcatcctgcgcgcccagcccgacgggtcgctgctgcgtctgaaggacgtggcccgggtcgagctcggggccaaggactacagctcgatttccaaacgcaacggcagccccacggtcaacgccgccatcttcctcgctcccggagccaacgccctggacacggccgagcgcgtcaccgccaagctcaaggaactctcggcccgcttccccgacggcatcatctattccgtgccgctggacaccaccacctttgtgcgcgtctccatcgaggaagtcatccacaccctggtcgaggccatgatcctggtctttatcgtggtctttgtcttcctgcaaaacttccgggccacgctcattccctgcctggccgtgccggtctccatcatcggcaccttcgccgggatgcaggccctgggcttcaccatcaacaccctgaccctgttcggcatggtcctggccatcggcatcgtcgtcgatgacgccatcgtggtgctcgaaaacgtcgagcgcatcatgaccaaggagaagctgccgcccagggaagccacggccaaggccatggaagaggtgactgggccggtggtggccatcgtgctggtgctgtgcgccgtgttcgtgccggtggcgtttctgggcgggctgaccggccagatgtacaagcagttcgccatcaccatcgcggtttccgtggtcatctcgggcctggtggcgctgacgttgaccccggccctgtgcgctacgctgttaaagcccggccaccaggaacccaaccggttcttccggggctttaatcgcctttttgacgccgtgaccgccggttacggcgcgggcgtggcctttctcctgcgccgcagcgcctttgccatgctgcttttcgccgggctgtgcctgggcacgggctggctgttcaagcaagtgcccggcggactcgtcccggacgaggaccaaggctacgtcatcgctgtcaacatcctgcccgacggcacgtcgctgcgcgcgaccgaacagatcagcgacgccatggacgcgatgaacatgcaggacccctcggtcaaggacgtcatcgccatcaccggccttgatctcttaagcttcacctaccgctccaactacggcaccatgttcatgccgcttaagccctggaaggaacgtcccggcgaggaactctcctccttctccatggtcaagcgcatctttggccggggcatggccctgcccaaaagcttcaccctggccttcaacccgccggccatctccggcatgtccaacaccggcggctttgaagcctacctgcaaagccgaggcgaaggcgacgtcaaggccctggccgccatgaccgaagccctggtggccgaagcctcgaaaaacccggtgctgggccgggtggccaccaccttcggagccaacgtgccccagctgcgcatcgacctcgaccgagaaaaggccaaggccctgggcgtggccataagcgacgtctatgccgccatgcaggccacgttcggcgcgtattacgtcaacgacttcaacaagttcggccggacattcaaagtccagatccagtccgaggccgatttccgcgaccggcccgaggatctgcgcgacgtgttcgtgcgctccagcaaaggcgagatgatcccgctgaccgccatcgcctccatcgaaaagtccaccggccccgaggtcatggagcgcttcaacgtcttcccggccgccaagatcatgggccagcccgccccgggacacacctcgggcgaggccctggccgccatggagcaggccgcggccaaggtgctgccaccggaatacaccctggcctggaccggatcggcctaccaggaaaaggccgcccagggctcctcggccctggtcttcgccatgggcatcgtcatggtcatcctgatcctggccgcccagtacgaacgctggaccctgccctttgccgtggtcatggccgtgccgtttgccttgttcggggccatcgccgccgtctacggccgggacctgagcaatgacatctacttccagatcgccctggtgacgctcattggcctggccgcgaaaaacgccatcctcatcgtggaattcgcggtgctggaggtcaaggccggcaagaccctggccgaggcggcgctctcggccgccaagctgcgctttcggcccatcatcatgacctcgctggcctttatcctcggctgcctgcccctggccatctccacaggcgcgggcgccaacagccgccacgccatcggcaccggcgtcatcggcggcatgctcggggccaccatcatcgcgccgtttttcatcccggtctttttcaagctcatcatgggtcttggggcctgggtgcaacaagtcaccgggaaacatgttgccaaggagcaaaaagcagactaatgcttttataagctataaaaaccatgcgcgcgggaagtcgcgacgcgcgtcggaaaaggagcacccccatggaatcctctccgtctgtcgctgtccccgagcaggcttcggaatccctccccattgccctgaacgacgtagcccgggcctggcggtcccgattggacgaacgccttcgccctcttggcctctcgagcgccatgtgggccgtcatccgccgcctggccaccggccaggcggcgttgacccaacgcgagctggccgaggccgtgggcatcgaaggcccgacactggtgcgcctgctggaccggctggaacagcacggcatcgcccggcgcgtgtccgacccccgggaccgtcgcatcaagcgggtggaactggccgaacaggcccggcagaactgggacgcctccctgaaggccggactggagctcagcagcgaactgacgcgtggcattccccccaaggacctcgaaaccacgcgcacggtcctgcgcaccatgctcgaacgcctctaaaggcggcccaacatccgccttgtccatcccgaaggtttggggcatactggctgcgagaacgacgacgttttccagctggttgccccaacccttaccgatgccggtcgcgcgcaagctcccgttccggacgccccgccagcctatgcccatctctgccgcgccgtcatgcttacgtctcgtgccgcgccttgcctccggctggctgctggccgggcttttgctcgtgtccctggccgctggctgcgcccagaagcgaccgccaaccccggtgcggctagctccggaaaccacggccgaatcgcctgaaagcgtcatcatgcgcgccaccccggccatcgccgccggccaggccacgcccaccgtctaccaggagcgcggcgaggcctactaccgtatggggcagttcgaactggcccagaaggatttcgaacaggcccagagcgccggcggcggcgcccagaccgcctacgatctcggcgcggccgcctacatgaatcaggactaccaaaaggccatcaactacttctccgacgccatcgccaaggacgccaccatggccaaggcctacaacaatcgcggcgtggcggcctttgccctgggccagtacgacaaggccggggccgatttctccgccgccgccggactgggcggccaaagcgccgcggcctcgctttttaaccgcgccctggcctatcaggcccagaacgaatttgaccgagccctggccgactacgaccgggtcatcggcctggacccgtcccagaccgccgcccgcaacaacaaggccgacatctacatcaccctgcgccgctacgacgaagccgccgtggaactcgacacggccatccgccgcaactccggcgaccccgacctgtattacaaccgcgccctggtccgggagaaactcggcaactatccccaggccatggaagactacgaccgggccgccaaactgcgttccaacttcggccaagcctaccgcaaccggggcgtgctgcgccttcgcttgcaaatgacccgcgagggctgcgccgacctctccctggcctgccagttcggctactgcggccacctggaaaaggccaagaacttcggcctgtgccagtagcggccgaaagcgacgggcgggcctcgtgaccgaatacggcatcagacggctggccatgggcgtaagcgcgctttgtctggccggggcggcccttgtcgtcgtcgccgcctggcgcttcgacgtagcaccccctgcgccgccggctccggccgccagccccaaggccccgcccccgcgccaggccaccgccgcgccggaactgacccgcgccatcctggccaacgacgtcttcggcttgacgcctctgcccgaccaacagcccaaggccaaacaaccgctcaaaccggccgaaatcgacatggaactggccggcacggtcattgccgccgacggccgccatgccgccgcctttttgcgtgacaagggcaacaaatcccagaaggcctacgccgtgggggccacggtcaaggatgcccgcatcaaatccatcggcaagaatttcgtcatcctcgaacggcagggccgcgaggagattttgaccatgaagccttaagcccggccctttcgccggcagcgcgccggcaaaatcccggccggcgcgcgatcataaggcccgccatgcccgtctacgaatacgccgccgtcgatgccaagggccgcgtcaaacaaggcatcgtcaccgccgaaagccagcaagccgcgagaatcgcgctacgggccaagcgacttttcgtcacttccctggccgaggccacctcgggcgcaacggcccggggtcgcggcgagacagcctccctgccgtttttcgcccgccgcatgggccggggcgaactgctcgccgccacacaggtgctggccacgctgctggaagccggactccccctggacaaggccctggccgccctcatcgagcagatgcgcgccggccggggcaaatgggtcttttcccacatcctggaacgcatccgcgaaggccaggacttttccaccgccctggccgcctatccggccgtgttcccgcccacctacgtcagcatggtgcgttcggccgaggccacgggcatgttgcccatcgtgcttggcaacctggccgaatacctcgaccgccagacccagctggcccgcaccctgcaagccgccctggcctacccggccttcatgttcgtcttcggcctggccgtcatggccctgcttttggcctacgtcatccccgaggtcacccgcatcttcgtggacctgcgccgcgccctgcccctgcccaccgtcatcctcatcgcggccagcgacttcgtgcgggcctggtggcctttcctcctcggcgggctggtcgggctggtcctggccgttcaccgcacgctgcgcaccaggcgcggccgggccctggccgaccgcctgaccctcgccctgcccgtggtcggccccatcgcccgcaatgcggccacggcccgcctggcccgaaccctgggcacctgtctcgaccagggcgtgaccatgctttccgccctgcgcatcgccggatcggtgtcgggcaacatggtgttcgaacaggccatggagcgcatccgcgacgaggccagccagggcggggggctcaccgaccctatgcgcgaggccgacatcttcccgcccatcgccctccagctcgtctcggccggcgagcaaagcggacgactgggcgaactgctcgtcggcctggcccggatgcttgaaaacgacgtcaacgcccgcatcaatagcgccagctcgctttttgaacccgtcatgatcctgttgctcggcggcatggtcggccttatggtgctggcggtgctgctgcccatcttcgaaatgagcagcctgatcggctgacaaccaaggagtccccatgcgcgccgccctcttcgccgcccgccggtcccgtcgcccccatcgccttgatgcggccggattcacccttattgaactcatggtggtcatcgtcatcctcggcgtcctggccgggcttgtcctgccgcgcatcgtggaccagcccgacaaggcccgggtggtcaaggccaagacgcagatcgaggccctgtccatggcgctcaaacagtacaaactcgacaacggcttttatcccagcaccgagcagggcttgagagcgcttcgggagaagccgtccatcggccgggtgccccagaactatccgcccaagggctacctcgactccctgcccaaggatccctggggccgcgactacgtctacctgtgcccgggcgagcatggcgacttcgacctcatttccctgggggccgacagccaggaaggcggcgaaggcgtggacgccgacgtcaagagctgggagcttggcggctgacggcccatcccgtggccccgcgccgcgccgccggcttcaccctggtggagctgaccatcgtgctggtcgtcatgggcattgccgccggcctggccatcccccaactggccggcctgttttcccgcgaaagcgagaaatccctggcccgccaactggccggcctgctgacccgggccaggaccgaggccatcgtcaccggccgaccctttgtcgtgaccctggactgggccaggggcgaagcccgactgaaaccgctgcccgagtccggttcgccggtgccggccgggcgtgacggccgcaaaaacgccgagcgctccaaggccgccgtggccaaggacgcgcccgggaacctgccggacccgtccggcgcgtcccggccgcccgtcgtcgtcccgccgaccaaaatcgccgacaaggcccggccgggcctgctccttacgccccagggccggttcagacagcccgaatccctggagctggtcgtgaccccgcagggcctgtgccagccggtctttgcccgcttggccgccgccggaggcagcgaggcggcggtggtggtcgatcccgtgggctgccgcgtgagcctgctgaccgccgacctggaagcggcccaggcccggttcgaaaaatctctggggctgctcgatccgccctggtccggggtggttcggccggcggacgcaccatgagcaaccgcccggagcgttcgcgcccgtcgccgcaatccggccaggccctgctcgaaaccctgatcgccgtggccatcatggccattgccctggtgtcgctgttggccggtctggcccggctccaggacaaacgtctggacgccgcccgggccaggcgggccgccttcctggcccaaggtaaaatgctggatatcctggccgccggcccggccaacctcaacaacgcctcgggcacgttccccgctcccgacacggactacgcctttagcgtggagatcggtggcacccggggcgagcggctgcgccttgtgtcggtcaccgtgcgcgccaccggctccgagcgcctgcaagtccggctggcccggctggagcccgggccatgagcgcctcgcgccggcacgaatccggcttcaccctggtcgaggtgctcctggccctgctcatcggggccctggtcatgctgggttcctattccgtcacctcccaggtcatcggcctgtccgacgacgtcaggtccaacctggccgccgaggacgccctcgatatcctgcgtatcgccttggacaacgatctgggatcgatcatctgggtcgaatccaccatacggagggctgccgaaagcatggccttttccggcggccgccaggaaacggccctctcggggctggacgaggaagtcatcctctccctggccagcgccgccgtcctggccccggacgcgccgtttccctcccacgccttcaaccgggtcacctatctcttgcgcaagccgccagggaaagacggggaaaaaacggacacgcgccagctcgtgcgtcgggaactgcccgccgccaccctggcttggcgggaccccgcccgacccagcgcccacgaaaccgtgctcttggagaccgtctccgcttgcgccatccagtttttcgaccagagcgccgcgttgacgacctgggacagccaggcacgcgtacaagcccgccaatctccgttgccgacccaggtccggttgcagggagaggccgtccttggcggcaagacgcgccgtttcgaggtccgctcggccttgccgttccgcaaccttgccgtgggggaagggcgatgagggccgaccattcccgaggcgcggtgctgctcttcgtcctggccctggtggcgcttttggcttccctggccgtgaccaccatccgcacggcccaggtcgaggttttcgcggcctatggcggcatctacgccaaacaggcccgggccacggccgaatccgggctgctggccgccgccgccgtgttgctgccggcccggcccgctgactccgacaacctgacccaggattgggcatttttccctgatctagccaactatcccggggcaagcttcctggacggccacataagcggccgcatcgaggacgaaagcggcaagtttccggtcaacgccatgcaccccggcctttccaaccatgccgcctatcaggccgtcttcctgcgcctattgaccggagaggcgctggccctgcccgaagaccgggccaaggccttgctggccgccctggtcgactggctcgacgccgacgaccagccaggggcaggcggcgcggaagacgccgcctacgccgccgcccagtttccttaccatgtccgcaacaactccctggacaccctgggcgaactgttactgatccaaggcttttcccgcgacctgctgcacggccggggcgaccgggcgggactcatgtccctgctcaccgtctggggcagcggccttataaacgtcaacaccgccccgctccccgtgctggccgccctgccctccggcctaaacgccgcccaggctgccgccctggctcgcagcctggacgcctatcgccgcgatccggtgcgccaaagcgagctggccagcctcgaatggctggccaaggccgccggctcgcacaacggccaatggccgaccacgctactcgccacgcgcagcctctactacgccgtcacccttgaaggccgttcgggtgcggccaccgcccggcttttcgccgtgctcaaacgtgaccaaccccgccagtcaggcaagcccccttcctgcacggtgctgtaccgggagttgcgctaagacaggctccatgccacaaggccgggatgcgggaatcccttctggtcgtggcgaggcggccgcgctccctcgcggtcctttgcgtcgagaccggcccgggcctgcccacgccaaccggcgcggcgacctttcccctgccccccgacgcctcggcggaggatgtggccgaaaccgccgcccggctggttcaggagcacggtcttgtcgcacggcgcgtggccctgggtctggacgccgccaaagcgaccctgcgccgcctgcctttcccctttaccgccccgggcaagatcgatctggtccttggcccggaattcgagccctttctgaccgcgccgccggccgagaccgccctggcctgggccgccaccgccctggccgcgcctcccgagaccgtggtcctggccgcagctctgtcgcgtgaggccctggtcgcccagacggccgccctggccgccctgggcttgcccccgcaagccgcctgcctcgatctggccggccttgacgccttgctccaggcgctgacgccgggcagccaggccgttctgtgcgtccatgtcgcggacggccgagccgatttcgtctgccgcctggacgacgcgcccctggcctggcgcagcctgcccctgcccgaggcggccgacgccgcgcaacaggcgacgtttctcgcccgcgaggctgtcctcaccctgtcggccctggccagccagccaccggtcggcctgaacctgatccttggcggcaaggtcgaccggccccaggcggccgccgctctggaagccgccctgggcgtgccggcaacgtccctgtccgccctgcccggctggccgcgcctgcccacgggcgaggcgttgcccgaagccttggccctggcttacggtctggccgtgctggcggccaaggacccgaaaacggccaatttcctgcgcggcgagctggccccggccgcctcgcgcgccaccctgcgccgcgccctgctcctggccggcggcagcgccctggtcttggccgtttgcgccattggggcgtatttctccatgctttggcggctcgacgcctccctcacccgaacccgggccgaaaccgaggccgtcatcgccgccgccgccccggacctggccccgagcttaaccctcccgcaaaaactctccgccctgcgcggccggctggccgaacacgcggccacccggcgcgaccagggaaccggcccggtcgggggtgttctagagatactggccgccatccatcagggccttggcccggatggcgcggccaaggcccgacgcgtggccctggacgagagccgggccaccatcgacgccgtggccgacgactacaccaccgtggacgccgtcaaacgccggctggccgccatggcggtcttttccggcgtggaaatccggggagccaagaacaacccggagaaaaaacaggtggaattccagctcgacctcaaactggccgcagccggccaaggcgcgccgtgaaacgcgagctgccccaccccctgctcctggccgccggcggactggctgtccttgtcggcctgtacctgtgggtcgtcgttcccgtcacggacggtctagacgcccgcaaacgccggctggccgaggccgggcgcggtctggaggaagccaagcggctggccggacagctcgccgccctgggccaggccccggccgcagcctccgtgccggacggcttctcgctgttttccctggtggaaggcgtggccagccgggaaggggccaagggcaacgtggaattcatgcgcccggccaatcgcgacctcggcggcggccgccgggaagcggccgtggatctacgcctggccggccttggcatggacaaactcctggccttcctgcaacaggtcgaagacccggcgcgcggcatccgcatccgccagctcatcctcaccccgtcgtccaagggcggcatcgacgccgacctgtccgtggccatgccccagtcagccgacaaagggcggtaaacgacaaagaaaagagaagatgcctccgacggccgggggcctgaggcccccggaccccccgcatgggaaaagatgtagagggggttcggcgtgggccggcaggctggttggttgtggaccgtcagcgcgggagactcagcccgaccggactcgtcgcgggcacgacaagaggctgcgttgctcgacggcgcgggaaaacgcgtccttgccaaggctccgggagccgggaagcgcgacgaggcgtcagcggacgccgctgtccagggtcgtggtcgttgtagtggtcgtggtggtcgtcgaagagagtgaggacgtggtcgagggcgtataccaggaactggagctgttggtggccgtggcggccgtggtcacgagcgcctgcagcgaggccgcctcgttcaggtcatcctgggccttttgggtgtaggccgcgctgttcgccggctcggcagcggccagggccgtccaggcggcggcccggtgcttgagggcggccacataataaggctggatggccaaggccttgtcgtagttggcgatggcgtccctgtagaggccggcgtcgtagcgcaaccggccgatggcgtcgtaggcccgggcgtaggctgcgtccagggacaacgccgtgttgtactcttccatggcccgttcggggtcgccaatggaggcatagtaggtgccccggtccacatagacgctcggttcgcccgggccgtaggccacggccagattcagctcggacagggcggccgaccccgcgccaaggccgatgtaggccagccccaggccgcctgtggccttggcgttgtcctcgtccacggccagggcggccttgtaggccagctgggccgaggcatagctgccctgggccagataagcgtcgccgagcagaatgtagccggtgacaagcttatccttgttattgagataaatgccgccgcaataggacgaatacatggccatttggaccagggtttcgttgtattcgttaagcgtctcgtttttttccttgtccttgtccgtcaaatcctcggacacgggcagtttctgactgccggcggaagaagcgaactggttggcgctggccgaggaggtcgtcgttcccgaagtggacgacgtggtggtcgagccggacgtgtccgtggtcgtgctggtcgagaccgggccggagccggtggccgtgccggccgtgctcgtgccggaactcgtggtcgagccggaggcggtcgtgccggaagtggtcgaaccaaggccggacagaccgccaagggaactcatgccgtacagggacgtcccgcttaagaggctgcccgagccaaggccgtagagggaagaaccgggatagccgtacgcggagccgtaagctgtggcgacgtcgagaatggggctttcgcccggcaagaactggtcgcaggtgtcggaagcgcgaagcagggccaagccctggctggcgtcggacacggcctgggacggcacgtccaagaccagatcgacccgcgcccgggccagataggcctcgccattgtcgggataagccgcgatggattcggtcagataggccagggccgaaggataattgttgtccgtcatggcggcggcggcgttggcgtaggcggcgtcattgcctgacgccagcccgccgagagaggacagggaagacgtggccgcaacggccggtcgggcgaccagaagggccagacccagggccatggccgccgcagcgcgttttcgtcccttgcccatgcgtctctcctttggcctgcgacagccgcgtaacgggccggcatcttccccagcatctaatggcgcgcgccagcgacgtcaaggcaggctcggggacgtcaggcccgtctggccgcctcggcccaggcaatctcccggatgatggactgcgtgacgcccccggccgtcagttggggcggcagcacgctccaggtgtaagtctccacttccagcggcgtgtccgggggaaacagcggcaaggcctggcgcaaaaaggcctgggttgtggcgcactgcggcaaggactcgatgaaaatgggcatgtggaaatgcacgcgccaggattcgacgcccgaaaggcgcgcggccagggcctttggcagatcgtcgaaccggaccagctcaccgccctgcagtcgggccacggcctggtgcagatagaccggctccacgaaacaggcaagctgcgtcagatcgccgccgtcgaggtgcagggccgaggacacctgcacctgccccacctcgatgccgcgtgcggcgagcaaggccagggactcggccgggtcctcgtattgcagggcctgatggcagcagtcatagcacacgcacagatgggccatgtgcctgggcggcgcgtccacggcctcgaaaaaggcggccatctcggcggtggtctcgatgcggcagccgggttcggcctccacggccaagcggatacgccggccggtttcttcatggagcgcggccagggcggccaggacgccgcgcagagaagcgtagaccgccggcaggtcggcgtcgggaaagccctggcgaaagcccaggggcacggtggagatggcgccggtcgcgccctcgggcagccagccggccaggagccgggccaggcgcagggcataggcggcgcgctcgggatcgcgccagtcgggccggtagacggcctccttgaccggcacgtcgtggaagcggccgtagggaaagccgttgatggtgcgaacggccaggttacgggcggccagttccccggcaaaggcccgggccgcctcggcgtcgcactccaggctggcccggcccgacagccgcagccccacgggaaagggccggtccgggcagacggcggcggccaccgccggggcgtggtcccacaagccttggcaaatctcgccaaagctctcgccgggatggatgttcgtgcagtaggtgacaggttccatggtcccctctctccccaattggggggtccgggggcctcaggcccccggccgccggaggcttctttattgccttcccgccagttcggcgcgggcggcttcgagttggggcgcatcgacggcgtgaacttcgatgcgttgaccaaggccggtcagcatggataggtggagccggccgccgaggtgttcgcggaaggcttcgatggctgcggccatgtcgaggtcggccagggccggatgccacacggccaggcccagggcgtcgagcagggacagcgcctgctcggcttcggcccgggagagcaggccggtgcggcaggaatagagggtatccagggcaatgcccacggccacggcctcgccgtggcgcagctcgccccgggtggcctcttccagggcatgggccgaccagtggccgaaatccagcggccgggccgaaccgagttcgaaggggtcgccgccgccggcgatatgctgcaaatgggcctcggcacagcgcacgttggcttcgaacagcgcctcgtcgtcgccggcggcgagcctgggggccagctcgaccagacgggcgaaaaagagcggatcgcgcaccaaggcgaccttgaccgcctcggccagtccggccagcacgtcgcgccggggcagcgtggccaacagggcatggtcgttgaccaccgcgtacggcggggcgaaagcgccgatgtagttcttgcggccgaaataattgatgccgtttttgacgcccacgccggcgtcgttctgggccaggacggttgtgggcatgcggatgagccgcacgccccggtgggcggtagccgcgccgaagccggcggcgtcgagaaaggccccgccgccgatggccagcacaaaggactggcggcacagtttgccccggaaggtcagctcccacacggcctggaccacggccaaatcggccttggccacctcgcccccgggcaggacaagcggcgcttcgaccagggccatgacgtcgccgtgggcggcggcataggcagtgacgcggccgggcaggccggggtcggcggcgaccaggccggcgtcgcagaccacgccgactttgcgcggccctgctccggcccgggccaggatgtcggccaggacggcattggcggggtcaaaggccttacgggtgaagaccacgggaaaatcgaacgtgggcgcgatatgctgggcaatggcgacggtcatggagcctcatgggtgacgtgcggcggcgcgaatgtcgcggcgacgaaaagcgcctctggcgtttcccggccaacagtctaaaaccaataatttttcataaaaaataccagggcatttttcaagggacgcgacgcgtggcggcgcgggccgacgcgggttgcaaacgtccggcccttatacccgtattattcgcttttttccaggggggcggccacggcgtccagaacgccgacccgcgagagcgcctcgtagagcaccaccgaggcggcgttggccacgttgaggctgcgcacctggccccagatggggatggtgaccagccggtgggcggcggccaggacttcttcggacaggccgctggattccgtgccgaacagcaggatgtcgtcggcctcgaagggaaaacggtgatggggtactgcggcgtgaccccggttgccggcggtggcggccaccagccgccggccggcccgggcggcggcgaaggaggggaagtcctcccagaccgtcaggttcacgtggggccagtagtcgaggccggcccgcttgaggtagcggtcggccagggagaagcccaggggcttgataaaatgcagcggcgtcttggcggcggcgcacagccgggccacgctgccagcgttctggggaatttccggggcgaccaggaccagttcgatcacgccgtctcccgggtgtaggggacgtccttgcggtagaccgtgccctggaagctggcgatgacatcgtccatgtcgttgctgatggtcacggcgtaggtggccattttattgccaagggagatttcggtggcctcggcgtagagggtggaacccaggccggccttgacgtaggcaatggaggcggccacggccaggctcagtttgccgtgggcattggaggccacggcaaaggccaggtcggccaggctgaagatcgccccgccgtgggccacgccggccccgttgcgatggtcgtcggtgaggtccatggccgtcttggcgtagccgggccgggcctcgacgatgcggatgccaagcatctgggcgaaccggtcgcggtcgagaaaccactgcatgtccatgggaaacgctcctttgcccgccttggcaggcggggtctggggatggaacgccggggcggcggatttgtcaagccgggcgtttggggctatacggggccagccctttgagggggaatccgccatgctgcgtcacgttatacacgggccgggccagagaccgcgaaaccggccttgggccatggttttggccgcgctgttggccgcgctgtgcctgacggcgatgctcggcgtgccggccctggccgcgccgccgggcccggccgacctgtcgcgcaccatcgagacggcccgggtggccatagccgggcatgagaagaccatcgtgtcctatgacgcggagatgcggtcgctgaccggcaacgatccggcctcggcccggcggcgcgaggaaatccgtatcatcaagcagcattacgttcgggaaatcgagagcctcaaggcgaagatcgtcgatgactacaaaaaaatccaggaattcaaggcacgtggcattcaatagtgacatgccggcgggccaaaacaaaaacgcctcgctttcgcgaggcgtttcggatggttcggtggtgggcgatcggggatttgaaccccggacttccaccgtgtgaagatggcactctaaccgctgagttaatcgcccgtcaaagaatgtacgtgggaccccctcccctggcaagcattattttgcaaaaagccaaaaaaaacgacggccacccagcggataaagcaacaacacactgaaaacaaaggacaaaccaagacatgcgactgctcgtgaccggaggctgcggcttcatcggctccaacttcatccgcgacatgctcacccgccacgaagggatctccatcgtcaacctcgacctgctcacctacgccggcaaccggcagagtctggccgacgtcgaggccgctttcggcggctcgcgctaccacttcgtgcgcggcgacatcgccaacagcgagctggccctgtatctcctagaggagcacaaaatcgaggccgtggtcaatttcgcggccgagtcccatgtggaccgctccatcaccgacgccacgcccttcgtgcaaaccaacgtgctcggggcccaaagcctcctcgacgccgccaggcattacggcgtgcgtcgcttcgtccacgtctccaccgacgaggtctacggcacgctcgggccggacgggaagttctccgaagcaacgcccttggctcccaacagcccctactcggccagcaaggccggggccgacatgctcatgcgggccgcttacgagacctttggcatggacgtggtggtcacccgctgctccaacaactacggcccctaccagttcccggaaaagctcattccgctgatgtattccaaggccatggccgacgaagccctgccggtctacggcgacgggctcaacgtgcgcgactggatctacgtcatcgaccactgccggggcgtggaactggccctcatgaaaggccggccgggcgaggtctacaacttcggcggcgacgcggaaaagcccaacatcgaggtggtgcgcaccatcctggccgccctgggcaaacccgaaagcctcatccgctacgtcaccgaccggcccggccacgaccgccgctacgccatggacttcaccaaagccgcccgggagctgggcttcgccccagcctgggacttcacccggggcatcgccgagaccatggcctggtaccgcgccaacggcgactggctggacagcgtcaacagcggcgcctaccgccagttcatggcctcttggtatggagaacgggcatgagcggagaagccaaagccccccgcgccatcgtgctgggcggcctgaccggactggtcggccgcccgctatcggcggccatggaggaagcgggattcgccgtgctgccgaccacgcgcacggtcctcgacccctttgacatggaggccgtggcccgggagatcgaacatttcgaggcgacccatgtggtcaacaccgtggcctacaccgccgtggacgcggccgaggacgacgccgacgaggcctaccgcgtaaaccgcgacctgcccggccggttggcccgggtctgccgcaaggccggcgcgagactggtgcatctgagcacggatttcgttttcgacggtgccaagggcgcgccctacgccgaggacgacgcgcccaacccggagtcggtctacggggcgagcaagctggccggcgagcgggccatcctggattcggggctggacgcgttccagatcctgcgcacggcctggctctacggcccgggcaagaagaacttcgtggccaccatcctcgggctggccaagacccgggaggaactcaaggtggtggccgaccagatcggttcgcccacctacacccttgatctggccggctggatcgccgatctggcccgcaccgaggccgccggcatcttccacgccgtaggctcgggccaggccagctggtgcgatctggccgccgaggccgtggccgcttcgggcctgccctgccgcgtcctgtccatcccttccgacgcctacccgcaaaaggccaagcgcccgccctactcggtcctggacaacgccaaactggccgcggccatcggccgcggcccccgggcctggaccatcacggtgcgggaatacgtctacgaactgatgcaggcgtcggcctgatcggaaaatgccatcggcatgggcagggtgaagcagaaggccgcgccctgcccgggctcggactccacccagatgcgtccgccatgggcggccacgatgccttcggcaatggccagccccaggcccaggcttttttctccggccgtgggccgggccgagaggcgctcgaagggcttgaacagccggtggcgttcctcggccaaaatgcccggcccctggtcggccacccgcaccaccacctcttccccggcctgccgcagggtcaggcgcacgagactgccgggcggggaaaacttcacggcgttggacagcaggttgtccagcacccgggcgataaggtcggggtcgagattcatgggcggcagatgcggggcgcgggtttccacccggatggacttgccggcggcggtggcttcggccagcctggcccgctccaggatcagggcgtcgagatgggccatgaccagggccggttcgagccggccggtttccagacgggtgaggtcttgcatattggaagccagggaacacagccgccggccggcctggctgatgaccgccgccatttcgcgcacttccccgccgatctcgccgcacaccccgtcgagaatgagattggccgcgccgacgatgccgccggccgggcttttgagatcgtgggccagcatggacaaaaacatgcggcgaagccgttccaggcgcttgatttcgagcatccgttccacggcttccacgccgtgaagcacccgacaatagagctcctcgcgctcaaatggcttgtgcagatagtcgtcgccgccgtttttgagaaactccgccgagatggaacgcggggccttgcccgagatgccgatcaggcagatctcgcgcagccgaaaccgccttcttatggtgcgggtcagctccacgccgttttgcaccggcatgtcgtaatcgatgatgaccgccgcgatgtccggccggtgttcgaggatggtcagggccttggccgccgaggcggccatgtggacccggaactggtagcgacgcagcagccgacgcaaaaaaaggcgcatgaaggccgagtcttccacaatgaggatgcgggcggcgcggtttttgagcagccggtccacataccgggccaccgcagccgggtcttcggcctcggccaccacgaaatcgatggcgtcgagttcctgggagagattgcgaaattccggccggtaacactcggccacggccagccagggcacaccgcttgccgccgaggcgacggccagacggcgcacggcctcctcgggcagggccagatcgaccacacacagcaagaacgctccgtcgccgtcgccccggcaaagcgcgtccgccgccgcgccgggatcatgaatttggacggcccccagccccgacagggaaccgcaatggcgcaccacggccgcagccagacagggattgtcggagacaaggagaatcttcgggtcggacatggcgggttacgtctctcccttcgaatatggaagtttttttaacagatgcccgcagccagggcaatgccgcagtgcgtcctttccccagcgggccctgcccgttggcgcctgtcgcgagccgtcgacaatggggttgacaatcgataagggtaaatctaagtatttcaatgcagaaattgccgcgcaaaacagttcaaacgataaataggctcaagttggcgtctgaccaatgccaaaaagaaccttatccgcgaatgttactatcgtgaaacaggagctgctaaacgacgaaacaacacgacaggccacccaagagcaaagacaaggcatactacggagataaaacgtgatttgcaatatatgtggaaacaacgaatttcaggatttcaatacgcgcaagaacattgcttgcaccaagtgccgctccctcgaacgcactcgcttaatgtggctctatattgaggaagaaaatattgatcctaccttcaaaattttgcacatggccccagaattaggcctctacgcaagaatacgctctctggtcgaaaaaaataattatactgtagccgactttgaaccaaagcgttactcatttgcaaaaaaatgcaaatatattgacctatgcgatctcgacagctggacatccaatgaatacgatctaataatacacaatcatgtcctagagcatgccagatgcaacattgcttatatactctaccatctacacagaatgctaaaaccttccgggctgcacatattcagcatcccttttctacatggcgagtatgatgaaagtttagccgacataggcaacaacgagagaaaacgaagatttgggcagtctgatcaccttcgaagatttggaatcaatgatatacataaacacatcggatcaatagttgacattccaaaagaatacgatgcggcaaagcattttggcgaagatattcttattaaatacaatatccccaggtctcaatggagagggttctcagggtcaacaatcttaaaattaaacaagaacagttacaaactggcaaatttagatcgttcccgttaatccactttgcgagaggctgtcgtcgctacgcccctgccggccccttgtccgccggcggcggcccggctaggatgattcatggtttccgttgtcttgcccgcacgaaacgccgccgccgtcctgcccgccgccctggagagcctgtccgcccagaccttggccgactttgaagtcctcatcatcgacgacggttccgacgacggcggcgccaccaggaacgtcgccacggccatggccgaccgcgaccgccgttttcggctcctctcccggccccacgagggcattgccgccgccctgaacgccggcttggccaccgcccggggacgctacgtggcccgcctggacgccgatgacgtctgcctgcccgagcgcctggaactccaggcccgccacctcgacgcccatccggacatcggactggtctcctgccgggcggcgtacggcggcgatggcgaggcctgccggggctatctggcccatatcgaatggtgcaacacggtgacaacccccgaagccatccgccaggccatcttccgggaatcccccctgccccaccccacggtgatgtttcgccgggagctgccggccctttacggcggctaccgccagggcgatttccccgaggactacgaactgtggctgcgctggctggaagccggcgtggccatggacaagctgccccagacgcttgtggtctggaacgatccgccgggccggctctcgcgcaccgatccgcgctacgccccagaggcctttttccgcatcaaggccggctacctggcccgacgcctggccagggtaaactctttccatccccatatcgtggtggccggagccggacgcgtcacccgccgccgggccgaactgttgtgcgatcacggcattgtcatcgacgcctggctcgatatcgatccgcgcaagatcggactgatgcttggcggccggccggtgctccattacaacgaatccccgggaccgcagtcgtgtttcatcgtcccctatgtcgccagccgaggagctactgatgtaattttggacagactcggcgcggtcggctttattccaggccgccactgcctgccagccgcttaatttcgccccatctcttgccttgttgccggaagtcctttacggaagccactggcggattttgccttgaggcaactcgatgcaccattccacggagtatccggtatggcttggcgacggctggaaagcctgcgcacgcgattgctgtggcttgtggcgttgaccctggccccggtcctggcgctgcacgtcgcttcggccgtggaaaaacagcgttccgcccgggtcgccgtggaccagggcctgcacagcatcgccgatctggccgccggcaacgcccgaagcctgctggagaactacgccaacatcctgcgcggcgtcacctggcttgccgtcatcaaatccggcgatcccgcccaggccggccgtctgctgaccgacgccctggccgtctttcccgccttccaggacatggctctcgtgcgccccgacggcacggtgacagcagcctctgctctgccaggcggggcgacgcgcagtctcggcgaccggccctggctgcgccaagctttggacgcccccttgtccacgatcatggccttcgggccggacaccctcgacggcaagcccggcctggtgctggcccaggccgtgcggggaccggacgacggcgtggtcggcgtgtgcgccatcaccctggccccggactggttcgccgccatcttcaaggacattcggatgcccgaggccgcccgggcctgtttgttcaccgagaccgggacgctgctgaccacttggccgccacgcccccaggccgccggcaagaccttggccggcgcggacgacgtcctgccgcatcttgaccaggcggcgagcctggtctggaccggccaggggccggacgacgagatgcagcgcgccgtgttcgcgccggtggccgcccctggcgggcaacgcctgtttatccgcttaagccagccccaggccatccatgaggccctgctcatcggggcctggcaaagcgacatgctgcttttcggcctggccgtggccctggccctggccgccgcctggtggttcaaccgggtgtttctcttgcgccccatgggccagttcgtggccatggccaccgacatggccgccggcaacctcgaccgccgctcggggctggccgaaagcaagggcgagatgggcgagctgggccgggccctggacgccatggccgacaagctcaaggaacgcatccgctttacccaggagctcatcgacgccatccccgtgccggtcttctacaaggatctcgaaagccgttatctgggctgcaacgccgcctacgaacgcgccatccggcccctggcccgcatccgcaggcgcaccgtccatgacctggaacttccggcccaggcggccctttgcgccaagaccgaccgcgccgtgctctcgggcgaagccgaaaccgttgaatacgaaacgtcgcttctttttcgcgaccagaccgtccacgacgtggtggtcttcaaaagccggttccacgatgtcgccgggcgtacggccggcgtcatcggcgtgctgctcgacatcaccggccgcaagtgttccgaggccgaacttctcgcttcccgcacacgctacaagctgctcctggacagcatgggcgatggctttgtcgtgctgtccagcgactaccggctggtggaatccaacccggcttttcaggagatgaccggctacggcccggatgaactggaaaaaatgacctatcgcgacatcactcccgaggcttggcacaagcccgaggaacgcctcctggccgaagtggacgccaaggggtctgccgaggttttcgaaaaagaatatcgccgcaaggacggctcgatcctgcccgtggccgtgcgcccgcaccggcatcccgaaagcccgggcgaggatcgccgctatttcgcggtggtgcgcgacatcgccgacgtcaaggccatcgaggccgacctgcgtcaggccaaggaggcggccgaaaccgccaaccgggccaaaagcgatttcctggcgaagatgagccacgagatccgcacccccctgcacgccgtcattggcatgaccgagctgaccctgggcaccgagctttcgccccagcagcgcgacgccctggaaaccgcccgggaagccgccggcaacctgcttggcatcatcaacgacgtgctggacctgtcgcgcatcgaggccaaggggctggaactggtcatccaggacttcgatctgcgccgcaccctggccggcgtggcccgcaccctgcgcccccaggccgcccgcaagggccttttcctcaccctggccgtggccccgaacaccccccgccatgtccggggcgaccagggacgggtgcggcagatcctgctcaacctcgtgggcaacgccgtcaagttcacccgggaaggcggcgtcaccgtcaccgtcgccgccccggacggcgatcccggccagttggaactggccgtggctgacaccggcatcggtatcgccccggatcgtctggagcgcatcttcgatatgttcacccaggccgaccgcactgtggccttgaacttcgggggcacgggcctggggctggccatctgtcgcgaactcgtccgcagcatgggcggcgagatcgccgtggacagcgttccgggccaaggcacggtctttcgggtcaagttgcgtctcaccccggcccaggtcgtcccgatcgagccggcccgacgcccggtggccgcgccccaggccgacgccaggcccctgcgcgtgctggtggccgaggacaacccgatcaacgtcaaggtggcgaccacctttttaaaccgccggggtcaccaagccacagtggccgccaacggcgcgcgcgccctggaatgccttggccacgaaaccttcgatttggtgctcatggatgtggagatgccggaactcgacggcatggaggccacccgccgcttgcgggccggcctggccggcgaggccaaccgccgcgtgcccgtggcggccatgaccgcccatgccctggccggctccatggaacgctgcctagccgccggcatgacggaatttctgcccaaacccctggatttcacgctgttggccgaactcttggcccgggtggcgtccgacggggccggcccggccgttgcgaaaccggccgcccaggccacgccggaaaccgccgccgtcctggaacacgaggcggccctacgccgtctgggcggcgacgaagccttgctggccgaggtggaagaggatttcctgcgccagtacccccgcaagctgcgacttatccggctgtgcagcgacgcggaaaactgggacgaggccgccctggccgcccattcgctcaaaaacgtggccggagccgtcggcgcggaatccgcccggcggctggccgggcaactggaagaccagcttcgccggcgcgacgccgaggcggcccatgaaacgggcctggccctcaaaaaaaacctggacgaggccgccgccgccatccggcgctcccgcccgtcagaggacgccgggccggcggacgccgccccccaggcgtagcaaaaacgaaagccgcgccaggccggcgcggctttcggaaagaacggcccgagccggcgtttcttgtcgcatccacgaaaagcctacaggacaattcgcggacaacagactaaaatcagtaatttttctgaaaaatactctcgtattttttcagggacgcggcattagcccacgggcaaaatcttgcggccgtactgttcttccaacacttcggccatggccagatagcaggcgctggccccgcacacgatgccttcgtagccggccagccggccgatggcttccgatcccagccagtcccgcaaggccagcaggaaaaagagcagcgtcagcgaaccgaagatgaaacgcaggaccagcgaaccgcgcaaggttccgaagaacatgaacaaggtgaaaagcccccacaaaaacagataccagcccatgaaggcatggggcgtggggtcggccagccccatcttgggcagcatgataagcccggccagggtcaaccagaacaggccgtagctggcaaaggccgtcagcccgaaggtgttgccctttttgaattccatgatcccggcgatgacctgggccacgccgccgtagaagatgcccatggccagcaccatggatcccacgggaaaccatccggcattgtggatgttgagcaggatggtggtcatgccgaagcccatgagtcccaggggcgcgggattggccaatttcgtttccattatagccttcctgtggcgtcgagggtggagccgggcgaccccgccgcgggacgcttcagccgcaaggccaatgcaatagagactttgggacggcaggtaaagacgtcagatgagtcttggccccacgccttgcaggcgttatttcgacgatgccggcagacatccggtcttggcgccggccgcaaaaaggccggagcaagggacaggcgaccgggtttggcgcgaggccggcgtcaaagccagggaccagccggcggtaccgttggcagccccctttgcccgggacgtcccaccggccaaccgctgcggctcagcccatttccacccggtctcggcccaggcccttggccgcgtacagggcgttgtcgaccctggccaggagagttacggccgactcccccgcccgggcctcggccacgccgaagctgcaggtcagacgccccactcccgtcaggtcgagaccggccacggccagacgcagcttctcggccaggacgcaagcctcggccagccccaggccggaacagcagatgaggaattcctcgccgccccaacgccccacgcccagcccagcgggcacggtctgacgcagcagatcggccagggcgcgcagcacgtcgtcgccgcgcagatgcccgtaccggtcgttgacggccttgaagtggtcgatgtcgaacatgatgagactcagctgccgcccctgccggcccagctcgccaaggccggccagcagcagatgttcggtgtgctggcggttggccagtccggtgagcatgtcggtggtggacaggcgggccagttcgatgttggtgagcgccagccgcgcatgggcctcggccaaccggttctgggtgtccttgagttcggagatgtcgacgccgatggcgtagcgcaccacccggccgtcgggccaggtcatggcccggacctgcatctgataccagcggtcgtcggactcgttgaagtgctcaaagacccgggtctcgccgctgggcaggccctggggcgtgagcagttcgcccaggcggcaccagggacagggctcggcccgctcgtaaagggcctcgtggcacactttgccggcatgatggccgaaatgctcgtaaaaggcccgattgctgtagacgatgcggtagctggcggcgtccaccacgtagatgccgaagggaatgagatcgaaatggctctcgaaaagggcgttttccatcatcacgaggcggctccgctgcggggcagggtcacaatcacggcggtgcggccaggtacgtcggcgtcgagttcgatggtcccgccatgggccttggcggccagggcggcggaataggccccaaggccggtgccggaacgtttgcccatggtgacgtacttgtcaaacatgtggtcacggatggcggcgggcacttctccctggttgcgcaccaccagggccacgttctcttctcctacgacaacatccacttccacgtcgccgccctcgggcgaagcctcaaggccattgaccacaagattttggagcatcggccccaagagcaggtcgtcgccgggaacttccacccgggccccggccggaaccgggcccccggccagggcggcatgcagctttcgcccccgggccatgggcatggaagacagccgggaacaggtgcgaacggccagatcgaccagatccaccggccggggagacagcacgaactcgccgatttccagccggtagagcaccagggactggttgagcatgtcgagcatggaatgggcagcctgctccatgagcgacacgatgtgggccgcctcggggggcaggtcgtagttttcgagcagcacctggggcaggccgatgagcgcggacaacggcgctttgaggtcgtggcgggcgatgcggtccacgtgttcgcgcaggtccatgttctggcgcagcatcgtgttctgcccggccagctccttgttgcggatggccagctccgcatgggcttcggccagacggttctgggtctccttgagttcggagatgtccacggcgatggcgtacttgaccacccggccgtcgggccagcccatggccttttcctggatctgggcccagcgttcgtcgcgttcgttgtagaggtcgtagacggcggtgcggccgtttggcaggccggccgcagtgatcagctccgggatgcggcaatgcaggcagggcgcgtcgttgtcatagaccaccttgtagcacttgcccccctcggccgggccaaggttctcccgggagtggcggttgaggaagaccacctcgtaggtggccacgtccacgacgtagatgccgaagggaatgacgtcgaaatgcgtctttaacagcgcgctttcgagcatggaggcgctttgcatcacaagtatttcgccgccaccgtttccagggtctcggccagtttttcctgtttgacgggctttaagatatagcccttggccccggcctctatagcgtccatgaccatctgctcctggccgtgggaggtgacgatgacgatgcaggccccgggatgcacggccagaatgcggcgggtggcctcaatgccgtccatatcgggcatggtgatgtccatggtggtgacgtcgggagcggcctcggcgtagacgtccacggcctgctggccggtggaggccatggcgacgacgtgatgtccgagttcttccaggagcttggccattttcttcacggtgaggccggagtcgtccaccaccaggattcgcagggatctcatgccttactccttcacatattcaagggcgtcgtcaaagagttcgcccggaccgatgaggtggatggccagggaaccggtcgcggcggcgagttcggccgaggcgaatttggccccgcggtggcgcatcacggatttggcttcggtgaggataatgggcggcgacagggcaatggcccggccggtggcggccacgtcggccagggcgttgcccacgatgatgttgatgatgtcgccggcggtttcctggatggcgtcgtcgcgttcgtcctcggcgatgtcgaggtcggcggtgtaggcggcaaaggccgcctcgataagggccgcgtcgaagctgtaggccagatagagcttgagctgcccggtggcgctcaaaatggcggtcagatggcgcaggtcgagcttttgcacatcgtcgaagtggtacaggggttccttgacggctatgcccagttcctcggcgaaaaacgcccgggtgcgcgtggccagggcgtcgaggaaggctttgagatccagttgttcggtcataacgtctcccgaaagtaaaacttaggcgtcaaggaggggaacttcgacgcgaaggcgcgaaccgcgcccgggttcactgatcaatacggccgccccgcccaggtgctgggcctcggcccgcacggcggccagccccacgccgcgcccggagagttctccgacgctgcggcgcgaggaaaatccgtcgcggaaaagcagttcgatcacggcggcgtcgtccatggcggccagttcctcggcaccgaccaggccgacctcgaaggcccgggaacgcacgccttccacgtccacgccccggccgtcgtcggccacctcgatgaccagccggccgttttcggccgcgacccggcagttgatgatcccggcttcgtccttgcctgcctcggcccgctcggctggtgtttccaggccgtggtccacggcgttgcgaaaggcgtggaccaaggccttggccaaggcgtccaggcggtcgggatcgacggccacggcctcgccttccacggcaaagggagccaggagcttaccctggccggcggccaggcgggcggccagacgcgggtaggcggccagcaactttttcacgtccacatggcgcaaggtgcgggcagcggccaacaccgtacggtcctgctcgccgagcggcagatcgtccaagcgcgaaagcagccggtcggccagttcggccagggcctcggccagatccgcgcccaggcagatttcgccccggcgatcgaaaaactcctcgcccagggcgtttcgcaccacggcgatgtcccggttaagcgcctcgtccacctcgggatcggccagtgcctcggccacggtcgaagcctggggggcatcctctcgggccagaccagccagacgcgtttccacggcatccagagcggccgcgacatgggcgcattccagctgcaaaaataagcccttgaaggtgtgcacctgccgataaacggattccagggcagcacggccgtcggcggcgctggaaacgaagacctgtcctgattcccggaatccggcgaagctgtcaaggacggcgaaaaagtcgcgctgctcccgcaccgccgccactacgcaggccaggcggttgcgctcccgggccacggcgtccttgaggcgcgcctcgtcggtgacgtcggtgatgacgaacataagccgccccccgtccaaggcgcggtaggccaggcgcagggcgcgtccgccaagctgagcggacttttgcatgagcgacagatacaggtcgcggcgataggcgtctgcctcgtcggccacccgccggatgttgacggccaaggcctccctggcggccgggtcatccgggaaaagcagctcgacgacgtttcgaccctcaatgtcgccgccgaaaatcgtccggcactcctggctgcaccgaggcccgaccaagccgttgcggtccaccgacaagaacccctggccggcgttgtcgagcagcgcggccatgtcccggttggcgacgtcgagcgcctcgtgggcctggcggatggcccggttgagccgggcaagcttgcggttccaccagacgatgacggccaggacggcggcggcgatggccagggccttccagaaccgggtgtagtcaaagctttcctcgaaggtgacggccacccacttcttgatgatcgcctcggtttcagccttggtgagggtgttgacggccttttggaacagcgaggccaattccggttcgtcgtcgcggctggccacggccaggtcgagctgagcgtcgaggcggccggcgatcttgagatcgctgaagtggtccttggcgatggcctggctgatggccggaacggtgtcgatgtagccgtagagcttgccgtcggccacaagacgcaggccctcggtgacgcttggcacctcgaccagccgcatttccgggtacttggaacgcaggatgtccaggctggagtagccgttgaccacgcccagatccttgccggacagtccggccggatcgtcgatgaagggcgtcttggccagggtggccaccaccatggggaagcgcaggtagggcgtggtgaaatggaggaaacgccgccgctgcttggtgtcgccggcggccggcaggaaatcgcagcgatgctcacgcacggcggacaggctctggctccaggagctggtgggcaccaggaccacgggcacgcccaggcgctcgctcataaggcccagcagatcggcggcgatgccgacgtggcggccgttttcgtcgatgcgctcgatgggggcccagtccgggtccacgcaaaaggacagggcttttttgcgggccagatagtctttttcccgatccgtgaaggtcagccccgtgtgcgtgtcggccggcttgcccatgacctcggccacggcctcgccagcctgggctccggccttgtacagcggcagccagcgggagagcagcgcggccttttccgattccgtcaccgattcatgggctttttgcagaatggacgccagcagcggccagtcgttgcgcaccagggaatatatcttgaactgatagtccagcagtccggaaatcttgacgttggccagccccgacttgcggatggcgtaggaagccacggccatgttctccacggcggcgtcggccttgtgggtggccaccagcgacagggcggcataggggtcggcggtctcgacgagctccaggcccggggccttttcgcgcaggtactcctcggccgtggagccccgggccacggccacgcgcttgccggccagggtctccagggaccaggccgcggcgtcgtcccgggcggccacggccagggggaactgccagtaagggccggcgaaaagcgcgtaggtggcgcggtcggcggtcttgccggtgccgtccaccagatcgatgcgtttgtcgcgcagggcatccaggacgagctgaaaatccagcccgtcgcccaggatctggaaccggaaggccaggcccgtgcgctgggcgataagggcataatagtcgtgaaaaaggccctgctgccggccgtcggccacgatggacagcggcggccagtccacgtcgctgaccgtgaccacgggatgggcctcgatgaaggctttttcctcgggcgtcaggtccagggccgcagcccaagcgcccgctcccccgaaaacaaccagtgcggcaaggacggccacaagccgccagacaaaggacgcacgcaaaaaacgcatcatgcagaccccgttgttcatccggcccgcagcatagcgcagcctgcctcgaagcccaaccccaaaaatcgggctattcgctcccaggcgagacctcaagggcaatggcgtgacgcaggcgcgcggcggccgcggcgccccggaaggaaccggtaaccggcgcggcgtcgtcgggatggggggcggcggccaggaccacgtgacggtcggtgacggccaggcccagggaaggatcgaagccgcgccagccgccgccgggcagataggcctcggcccaggcatgcagatcgcgctcgtcgctgtccgggtcgccttcgtggtagccgctgacgaaccgggccgggatgccgacatggcggcaggcggcgatgaagaccagggccagatcgcggcaggcccctttcctcctggccaggaccgtgtccggagccatgaggcctggctccaggcgggcggaggtggccagccgggcgtgcatccgaccaagcagctccatggcgaaggtctggggcgtggtcgcgccgtcggccaggatgccctcggccagttcagctgtccgggaggcggccccggccaccggcgccaggcagtccccggccagccaggcctcgcccggcgcgaggggcacgggcagcacggcccggggcgtttcgatgagatagtcgaaggggttgtcgcgaagggtcgccaccgtcgtttcggtggtcacggtcagatggtcggtgaggccggaaaaccagaccgacagggcggtgttgccccaggcgtcggtgacgaacgtccggccggccggttcgggcttgatgacggcggcaaaggccagcagccgctgggcggcgtcgccccggggcaccaggcgcagcaggtgcggctccagaaagacctcgcgcccgtaatcataacgggtgcggtgaacgatgcggcagcgcacggggtcaggccggttcggtcaggcagccggacttcccgcacacctttttgagcttggaagccacgttgtcgatccactccgagggcaggtcgtggaccaggccgcgcagatgctcctgccaccaggccgagatgtcggccaggtcttctttttcgtagcggtgctggaccagctccaggccgcttttgtggtagagcaccacgtcgatgggaaaatccacgtccgaggcgctgatgcgggtggagtcaaaggccaggcagccgaccttgagggccatgcgcagcggatcggagtatttgagcgtacggtcgaggacgggcttgccgtagccgccttcgccgatgatgtggtagggcgtgccctggctcacctccacccagttgccctcggggtagatcagatagagcttgtgggtggaatcgttggtcatctggccgccaaggagcacatggagattgaaccccagccccgactcggccagaaaggccttgtcctcgacggcgaccttgcgcagttcggcggcaaaggcgttgacgaccttgtagagcttgtcgaggggcttggcgcaggtttccatggcctcttcgaaataggtgagcgtcttgtcgcgcaccgagcgaagccccgaggtcatgaggaaaaaggccccctgcccgttctgataggtggtgaccttgtgggcgctggtcaattcgttgccggaggtgatgcgggtgtcggcgatgccgaccaagccttcctccacggtgatgccgaggcaaaatgtcatggccgtccctttgtcactgttggctggccccgtcaatagccggaaacgtggagaagaaggtggcgaaaacagcctcgtccacacggttcatgcgggtttgcaggttgtcggtgaactcatgcaagcccttggccacaacgtcttccacgctcatataggccaggtcgccgcacagctggccgatgcgtttttcggccggattggcgaaatagcccatgggcgtgccggtgatggcgtgcaggcactgctgggctcgtatcagcgaccacaggaccgaccggggaaagtcgtggtcgagcagcaagaattccacgatgcgctcgggctggatgcgcccatggcggcggcggtaggcctccagggcgctgatggcctttaacagcgccgcccactgcacgtagtcgaggttggagccgacgtcggtggggtgcggcagcaggatgaagtatttgacgtcgaggatgcgcgaggtcttgtcggcgcgttccagcagcctgcccaggcggaagaagtcccaggcctcgtcgtggctcatggcgtcgccggcgatgccgcttatcgtcaggtcgcggcgcttgacctcgtcgcagaagtggtaggggttgttgagcacggcgtcgcagcccttggccgcctcgcgcacgagatggtaaaacgtgttgatctgctcccacatctcggtggggatgatctcgcggatggtgcgggcgttgtcccgggcccggcccaggcagctcacgatggagttggggtactccggatcgaaggccaggaagcggatgatggtctcgcggtccccgggcaactcccgggcggcgaacaggtcaaagtcgcccatggccgagaccagcggcatccactgctcgccgcgcccgcccggggtgtccagggtgaggtgccagttgacgtcgaggaaccgggcgatgttctcggcccgctccaaatagcggctcatccagtaaatggcgtcggccacgcggcttaacatgcggcgctccttgaaattatagccatacaactaccctctggccgcagcgcccggacccagcacccaggtgtccttgctgccgccgccctgggaggaattgaccaccagcgacccgcgccgcagcgccacccgggtcaggccgccgggaatcacccggatgtcgtcgccgtagaggatgtagggtcgcagatcgacgtggcggccctcgaagtggtcgtccacgatgaccggggcccgcgacaggctgactgtgggctgggcgatgtagttgcgcggatcggcctcgatcttggcggcaaaggcctcgcgctcctcgggggtggccgccggcccgaccagcatgccgtagccgccggattccgccgccgccttgaccaccatcgtgtcgaggttagccagcacgtgctttctggccttgtcctcccagcacaagaacgtctcgacgttgtcgatgagcggctcctcgcccaggtagtagcggatcatgcgcggcacgtaggcatacactaccttgtcgtcggccacgcccgtgcccggggcgttggccatggccacccggccggccttgtagacctccatgatgccgggcacgcccaaaagcgaatcaggacggaagacctgcggatcgaggaaatcctcgcccacccggcggtagagcacgtccacccgcttgaggcccttggtggtgcgcatgtggacgtagccatcggccacgaccagatcgcggccctcgaccagctcgatgccggcctgctgggccaggaaggtgtgctcaaaataggccgagttgtagacgccgggagtgagcagcgcggccgtgggccggttggccgcctgaggcgcgatggcgtggagcatgtcgaggagtagcggcgcgtagtcgtccacgggccggatgtcaatggcctcgaagacctgggggaaggtgcgcttcaggatgcgccggttggccaggacgtaggacacgcccgacggacagcgcagattgtcttcgagcaccatgaaccggccggactcgtcgcggatgaggtccgagccggtaatgtggcaccacaccccatgcggcggattaagcccctggcactccttgaaatagcccgaagacgactccaccacgacgcgcggcaccacgccgtcggccatgatgcgccctttgtggtagacgtcgtcgataaacaggttcagcgcccggatgcgctggataagcccgcgctccagggcgtcccactcggcggcctcgatgatgcgggggatgatgtcgaagggaaagatcttctcggtcccctcctcgtggccgtagacggtaaaggtgatgcccatgtcgtaaaaggcctgctcggcggcggcctgcctggccaggatctcgcccggcggcagggaggcgatcttgtcatggagcatccggcagccggggcggggctggccgtcgggggtgaacatctcgtcgaaaaaggggccgacgtcgtagctgtcgaagtccatcttcggtggcatgggcaagccttgtcgccgcttcggcggccgggtaacacaggtgtcggtcggggtctttccgccttggcccgccacggatttgagcgttccaattacggaatttgttaataatattccataccgcctgtcaatcgcccttctgcgtcgcgacaggcaagacaggaaaaaacatgccttcccacgccatcgcccagctcgcccgggccattgccgacatccttgaaaggggtcttccccaggacgaagccgccctgcactgcatccgctccacccacggccagctgtccccggccgccatcgccgccctggccgccgacgaggacgatccccaagccgcaccgcttttggaattgctcctcttcccgggccgggccaccgccctggagctggaagaggccatggcccaggccgccctggagccgaccgagctgccggccctggccgaagccctggccgggctggggccgcgtccgaccgccctgctcccggacggcgaagtcgtgcccctgccggtgctggaggccgatcaggcggcccggctcgtggcccggctggccccccagcgcagcctgccggcggcggcccggcaggccgcccaggccgcctatcccggcctgggccggcgtctggccgccgacgcccgccagatcgggccggtctggtcccggggggccttggcctttttcatcaattgcttgcaacgcctgccggccgtgcgcccggacccggaaaaggccttggcggtagcgcgatttgtcctgcgcttcctggccgatctgccggagagcgccctgcccctgccggcgctcatggcccgccaagctaagcttgtcgcccaactgcgccgggccaggctgcaagaagaggccctggccaagagcaatttcgaaacgctcattatggccggcaaccgcctgccctatctccatgccccggacatcgccgaggaactggccctggccgaagcggccatcctggccgtcacgggccggcccgcgcccgaggccgggccgagttgccaggacctgggcgcgtttacggaaatgggggatattttcgccgccctggacgatcaggcggccggagagccggaagaatcgcggtaaaggggcaggcgcacccggatatgggtgccggccgtctcgtcggtctcccagtgcagctcgccgccgtgcagccgggcgatggtgcgggcgatgtaggccccaaggccggtgccgccgggcttgccgctggtggcgtacttggccgcgaaacgcccacgaatgccggcgggaatgaccccgtggttgtggacgccggccacggccgcctcgtcctccacggccagggacagggtgacggccgtgcccgggggcgcggcttccagggcgttggtgacaagattggaaaaagccgtggctaaaagcccttcctcgccggcggccagggggccgtcgtcgtcctcccggaagcccggcccaaaggccagttcggcctgccgccgccgggccaggggagcggccagggaggcctggcggcgcaacaacgcggccagggccacgggctggggccgcagttcgtaacgtccctgttcgatgcggcacaggtcaaggttgcgagacaccatgtcgcccaggccggcggccgtttcccggatgacgacggcgatttcccgttgcttgtcggtgagatccccttcggccaaatgcccggccagtccggcgatgccggccaggggcgagcgcaggtcgtggcgcagcatctgctccacccggtcccgggcctcctcggcccgcacccgctcggtgacgtcgtggatgatggagaaaaggagcttgcgccccagatactccaccggcccggtatagacctccacctcgcgcacctctcctccggccagcctgtgccggaagcgaaaaaaccgccgttcggcgtcgccggtcagggccatgtcccggcgcgtcgcctcctcgccggccgcgttgatgtcccagatggacagacgctgcatctcctccagggaatagccgtaaaaccggcaggcggccggattggcgtccacgatgcgaccgctggccggatcgatcagcagcttgatggcgatgttggaaaaaaacatggcccgatgccgggcttcggagtcggccagggcagcggccatctcctggcgcgagagcaggatggccagccccgtggccaggcgctccagccggaccacggccggggcgtccagcctgtccggccggcggtcattgatctggagcaggccgtgggtggtgtcggcggcgcgcagcggaacaaggaccacggtctcgtagccggcggcgttgcagcggttgcgggtcccgggcggcagagcaccggcctgggccagaagccttgtggtggagccggtgaaaaaactgccaaaaggcgtgaaacaaggcagacggggatcgacgcggccttgaataaccgcgccgcacatgcattcaaacacgggccgtgcggccggatcaacggagtcttccccggacttggcgcacagcgacgtctcggcggcgacgaaaccggcggcaaaaccgtcggccacgaaatagggatagtcttcgccctggcgcagacggatgcccacggcgtcgcagcccgtgacacggcgcacgattcgcgccgccacgtccaaaagcgcctcgcggtcgggcacggcctccaacaaggccgccccgtcgtccagcccgtcctggcccggcgtcgctgcatcctgaagactatccatggcccgacactagcaccaggccttggataatcacaagagcggcggaaaggacaggacgcaaaaaacgtccgaccgcccgaaacagacggccggacgcgtcaaaagcaggcggtgatcttggccagcatggccgcgaataggccggcttcctcaggggacagggcgcacaggatctcctgggtgagctgggcgtggagcttgtggtgctcggcaaagagccgcccgccctcgggagtcagccccacccggatggaacggcggtcggtctcgtggggtttgcgggccacgaagccgccccgctccagccggtccaccagcacggtgagcgatccggtggtgatgcccatcttggcggccagctccgtcatgcgcaggtcgccgtcggccccgagaatctccagcgtatgcatctggggcagcgacagtcccgattccttgaccacgccgtgctcccacgaggaaaacttctcgtagaattcaatgagcaggcgggtgagttgttcgttttccatgccttactgtttggcggttgcggccgtaacggccggttcggcggtaaacgccaggctggccgaggacaggaccaccacgatggagccgatgttgtggaaaagcgccgccgccaccggcgacagcaagccgtagccgctgccaaggatggccacggagttgaaaaaaagccccagcccgatgttgacggcgatcattgtggtcatgcgccggccaagatagaccagaaacggcagccggccaaggtcgtcgttggccagggcgatgtcggcggtctccagggccacatccgagccggccgcgcccatggccacgcccacgttggccctcgccagggccggggcgtcgttgacgccgtcgccgacaaacagcacccggcggccctttttctggaagtcggccaggatgtcgagcttgtcttggggtttgagcccggaccagacgtcggacaccccgatccggccggccagggtcgaaacagccttgtcgtggtcgccggacaaaatgcccacggtggcaagccccaggccgcgcagcccggccacggcggcggccgcctcgtccttgacggtatcggacacggcgagcaggcccatgaccgccccgccctttcgcaccaccagtcccgtggccccccgggcatacatcgcctccaggcaatcggccagtcgcggcggcaaggcggcggccccgcccatcatctccgggctgcccacttccaccacctcgccgtccagttccccccgaagccccagccccgcctcggcggtcagggaatcggccagacgcgcctcgacgccggccgccctggcggcgtccagcacggccgtagccagcggatggttgcagtggcgctccaggcaggcggcgcagcccaggacctcggcctcgcccaccccatcagccgggatcacggcctcgaccacgggccggcccagggtcagggtgcctgtcttgtcgaaaagggccacgtcagcccgggccacctcttccaggtactggccgccctttataaggatgccccgcttggccgcccggccgatggccgccaccgtggccgtaggcgcggccatgagcagcgcgcaagggcagccggccaccagcacggccacggcccggtcggcgtcgccgcttataagccaagccaaggcggcgcaggccagaaccaggggtgtgaaatatttcgcgtggttgtcgacgacacgcccggcccggggcttgccggcctcggccgcgaccacgagcttcaccaccttgccaaaggtcgagtcctcgccaaccttggtggcccgggccgtcacccggccggtgtagttgagcgtgccggccaggatcgtgtcgccggggacccgctcgcgcggcagggattcgccggtcagggccgactcgtccacggccgtagtcccggcctcgatgaccgcgtccaccgcaatacgctcacccggccgcaccatgaccagatcgccggcccggacctcggccacgggcacgacccgctcggctccgtccgcgccgaccacggtcgcctcctccggggccagctgggccaaagcctcgatggagcgcctggccccgtcgctcaccgcctcttccaccagcgcccccagggtcatgataaagctcaccacggcggcggtgagcagttccccctgtaaaatggaggcgacaatggcgatgctcaccagctcgtcgacgttgacccggcgctccaaaacgcccttggccgcctcgaccacaatgggcgcgccgtttatggccaccgccaccagggcaaaagccccggccccaaaaccccagccgttctcgcccagtatccaggcaaccagggccagcgccccgccgcccaggcacacggcgaaatccttgaaggagaaaagcccccgatagtcgcctaggttcgaaaatcgtccgatcatgggtacacctcgttagtgtgcgaaatagaatacgaagagtgcctccggcggccgggggcctgaggcccccggaccccccaacgggaagaaagggggtaaggggggcttgtcgggccgccggattggtcggatgcgccccgcgacagaggatcaataggaaacaccgatgcggcgtctgttttccggtccatcccccgcagccttgccatccgcccaacctacggccttgccccgtaagccctgggctttgcccggcggctttgagccggacggcgtgattccggttcccagcaacgccgttgccttgaagacgtgatatctctattgcatgaaattttgattgtcaaatatcttgaaagacaaaaaggcgaggaagtcgccttccccgcctcacatcaaaacaagcgtcaggtattacaagcccttttcggccataaaggcgaccaggtcggacacccggcaggaatagccccattcgttgtcgtaccaggccaggatcttggccatgtcgccgccctggacgaaggtgtattcgccgtccacgatggaggaacgggaatcggccttgaagtccgaggacaccagcggcagttcggagaagccgagaatgccggccagcggcccgtcggcggcggtcttgagggccgcgcgcaggtcgtcggtggtggtggatttttccagctgcaccacgaaatcgaccagggagacggtgggggtcggcacacgcacggacagccccgagaatttgcccttgaggtccgggatgaccagggccacggcctgggccgcgccggtggaggtcgggatcatgttgcaggcggcggcccgggcccggcgcaggtccttatgcggcagatccaggatgcgctggtcgttggtgtaggcgtggatggtggtcatcacgcccttgacgatgccgaagtgctcgtggaccaccttggccaccggagccaggcagttggtggtgcaggaggcgttggaaataatgtggtgggcggccgggtcgtacttgtcgtcgttgacgccaaggacgatggtcaggtcctcttccttggccggcgaggtgatgatgaccttttttgcgccggcgtcgatgtgggcctggcacttggggccggtgcggaaaataccggtggattcgatgaccacgtccacgccgagttcgccccagggcaggcccttggggtcgcgttcggcgaaattgcgaatgtgccagtcgccgaccaccatgacgtcgccttcgacccgggcggccacgggcagcttgccgtagttggtgtcgtaggacagcaggtgggcgttggtggccacgtcgaacaggtcgttgatggcgaccacgtccatggcctcggcgtggcgttccagaatggctttgaggacttgccggccgatgcggccgaagccgttgatggcgatgcgaagcttttgcatatgccgtttcctctactcgtgcatggtgtattcgtaggcggtcagcagttcgtaatcggtgcgcagcgcctgatgcagccgggcgttctcgatggccatggccgaaaggttggcgatggccgtggcaaaattgatctcgctttgggagaactcgcggatgttggagcagtacaggcgcatgacgccgatatggcggccgtccacggtcagcggcaaggccatgaccgaggcgatgccttcctcgcgcgcggcgtcggggtactggaacatcggatcggaaccggcgtccttgatctgcacgaccttgccggtcagggtttcctggtcgatgcggcttttggccacctcgatggttcctttgcgcagatagcccttgctcaggccatgggaagtgccggcaagcaaggtcttgccctggcggtccagcagccggatggagcaggccttggcggcaagggatttggtcgcctgctcggcgatggagtggaggacagtggccggctccaggctcgaattgatgcacatggccacttcatagaggctgcggtaataggcgcattcctgttcgctcatgactccctcccgcaagggggtggttggggcggcggcggacgatccgccggccgggtctcgtctccatgccggtccattgcgaaggccggatgacgactgtgcggcagcatacggaatttgaataaaaaggaaaaggttttcattgtaccggtaagcctgaccgtaagcagcccgatccagcccgtcttcccggcgtggtcacggcaggctggtcaattcggtactgcgcgatggtagagggctgttccggactgtcccggccgggttgcaggcccggccgccttcaggcggccggctgctcgaaccgggcgacgttgttgcgtccgccggatttcacctgatacatggccgcgtcggcggcggcgatgaggtcgtcgccggacatgcccgggacaaaggcggccacgccaatggacacggtaaaacggatgggcgcttcagccagcttaccgtcgatgcgggggcgaaactcgtagttctgcacggccagccggatggcgtcggcatgaaactgggcgtcgtcgccgtccaggtcgcacaccagcaccagctcgtcgccgccgtagcgggcggcgaaccagccgtggcgaccggcatgggcgtcgatgatcttggccagggtacgcaacacgtcgtcgccgaccacatggccgtaggcgtcgttgatggcggtcttgaagttgtccacgtcgatcatcatggcggtaagcggcgcgccctcggcctcggcccgggccacggccgcgcgcagatgctcttccagggagcggcgattgtgcaggggggccagcagcgggtcgacctggatgatcttttcgagctgctgggccttgcgttcccaggcctgggcctcctcgcggtaatgggcgagcatgttgccgaccagggtgcgcagcttggggatcatgaccgaggggtcctcgccgccggccagggtatcgagggtctcacggccaaagcggcccacgagcttgctgcgctcctgctccgaggtcagcgtctcttccagaaaggcggtaatggactgggccagggatttggaggccgccttttcgttttcaagctggtccttgacggcggccatgggcaggtggtcggtgagaaacagttccaggccgccaagcaggcgttggagatgttcgggggaaggatcacgccgggccagttccgaaaagacgtattcctgcaggcacttcttgcgcgagtcgtcgaaaatcgaaaactgccgcagcaggttgcgcacaaaaagcagcaccgccagccaggacgaatcattgccgcagccgagtttgtgaagctcgccgcacagtttgcggatgtcgcacggcgcttcctgacagcccaggtgcatcaaacccttcctccccaaacggtccgcatcgaaacggtcggtctgccatcaatccaacgtactgcataacccgcccgcgcgcacggagcaagagccgacgcgcgctcccgccgcaaatcggatcatttttgtctttgccgacagacagagacattttgacccacaccctttgtcccaccgccagagccggtgacattttgacgcaaagcccgatacctctttacctccgtcccggttttgattactggagtcaattttcaagccggagctgtaaggccggcggccgaggaggacttcatggatcccaaggacgtcgaatttttccgcgaacttctaaacggcatgctccaggacatcctcaagaagggcgaggaaaccatcgaggacatgaccgacaccgtcgaggtgtacgccgacccggccgaccgggccacggccgagtccgaccgggcctttaccctgcgcctgcgcgaccgggaacgtcgcctgatcaagaagatcaaggaagccatcgagcgcatcgacgaaggcacctacggcgagtgcgtggagtgcggcgaggacatcagcgtcgcccgcatgaaagcccgtccggtcaccaccttgtgcatcaaatgcaaaagccgccaggaggccgacgaagacctccggggagattagcgccgcgcccttggaaaatacgcccgtattttcacccggggcaacgctccggggtattttcctttaagctccggtcaacggacagaaaggacgcagcgccaaagccggccggccaggcccccgatccgccaaagacggcggcggtcgttgttgccggttcggccgccggccccgcctggcggcagacaaaccctgtccgggacgttcccgggccgggaggagacgtcgcccatggaggccgttttttttcgtgtcctggtccgcgagctggccgcggccctgccgggcgctcgggtggagaagattttcctgcccgtccccaacgtcttcaccctgtcgctttatctgccggtcagccgtgtcgtccccggctgtcccggcaagaaaaccgtccatctccacgcccgctacggcacggggcgttttttcctgttcctctccggctccaaaaccgcccagcccgaccgcgccccggggcaagccatgcggctgcgcaagcacctgcgcggccggcgggtgcagcgcctggttcccgactggccaaaccgccgcctgaccctggtgttcaccggcgacggcccggccctggtccttgatccccgctccttcccggtcctggccgaggcgccggccccggacgcgacgccggccgaaccgggctggccggccatcgaaaccgtcaccagcgatcccgacatctggcaggcccatccccagctctcgcccggcctgcgccgccgcctggccgccctgccccgggacggccgccagacggtctacgaccggttgcaggcggacacggccgaaggctttttcctggagcgcaaagggggcgagcccctggcgctttggcccgtggtctggcccggcaaaccccaggccggggtcgaaaccattgcctttcccacggccctggaagcggccgccgccttcggcctgcccctggccttcggcgaggtctcgggccgtcgcgaggctcccgaggccgacgccgtcgccgcccgggtccgtcgccgccagcgcgccctggccaaactggaggccgacgaagcccggatgcgggcctttatcatgcgcaaagccgaggctgaccgcatcgcggcgcacctccatctgctggacaagacggccaagattcctgaactttttttcaccaatgacgacggcacggaaacggccctgaccctcgacccggccctgacgatccttggcaacatgcaaaagctctatcatttggcggcaaaaggccaacggggcctggtcgccatcgccgcccgccgccaggacttgcaaggcgataaaaaagacttaaaaggtcgggaacacgtcccggcgtcccaaagcgccgtcggggcgtctggcagcctcaagggcgtggccgcccatgtctaccgcacttcagacggctttttggccctacggggcaaaaacgccaaggccaacgaccagctccttagactcgccaatgcctatgacctgtggttccacgtggccaacggcccgggaacccatgtgattttgcgacgcgaccaccccggacgcgacgtgccgcgacgcagcctcgaagaggccgccggactggccgccctggccagctatgcggccggggccggcacggccgacgtctggctggcccgggtcggcgacgtgcgccgggtcaagggcggcgcgccgggccaggtgacggtgacgcggatgttggagacgctacggacggccgtggacccggccctggaaagtttgcgggaaaaggcgtgaacatgcggttttgcttgtccttgtcggcgcgttgtattaattgcctgaccggagtgcgcgcgcgggttcccgaccgtaaccaggcttcgtgacgttatgatggaaacgctgtgcatggagcgacggctcgactttgacgacccggcgctcgcccgggacctttttggcccccacaatgccaatatcgccctgatcgccggcaaatccggcgcgcgtctcgacacccggggcagctccgtgattttgcgggccgactccgaggagacgctctctcatgtggccaacgtgctggtacagctctacgggcttttgcgccagggcaagcccatctatccggccgacgtggaacaggccttaagcgttctggccaaggagcccgaggccagcctccagcgcgtctaccgcgaggaatccctcgtcatttcgcccaagaaaaccgtcaccccgcgcaccgccacccagcgcgactacttggccgccataagacggcacgatctggtcttcggcatcggcccggccggcaccggcaagacctatctggccgtggccatgggcgtggggttcctgctggaacgacgggtcaagcgcctcatcctcacccggccggccgtggaggccggcgaaaagctgggctttttgcccggcgacatggtggagaaaataaacccttatcttcgccctctctacgacgccctcaacgacatgctcgacttccgcaaggtacgcgagatgctcgacaccggcgttattgaagtggctcctctggccttcatgcgcgggcgcaccttaaacgatgcgctcatcattcttgatgaagcgcagaacacgacgcccgagcaaatgaaaatgtttctcacccgactgggcctgtcctccaaggccgtggtcaccggcgacgcgacccagatcgatctgccgtcccatacggcctcgggactggtcgaggcccggcgggtgcttcgcaacgtacgcggcatcgagttcgtcaccttcagcgacgccgatgtcgtccgccatcccctggtgggaaggatcgtccaagcttatgagcgagatagtcgacagggttaagcgggccatcaaggccccttcggcccaatccccggtacagcaggcaggcggcttcacgttgcccgaatgggcaccgggcttcctgtttttcctggctgtggtcttcaccttgtgcttcgtggcccgcctgggcctggacacttcggtgcgtctttttaccgccggcgaaatcgccacccaggacgtggccgccgaccaaagcctgcaaatcgaggacgtcgaggccaccacccgccgccgcgaccaggttgccgaggcccagcccccggtcttcgacgtcagccccctgcccttcgaggccctggccaaaagcgtcgaggacatcatcggcgcggcccgggccgccacggccgaggatctggaaaagctgcgctggcaggtggccgagaacctcaacaccgacatcggcccggacatcattgaggtctggcggcaggacgacttcaaagcgctcatgcaaaaagacgtgctgccctggctcaagcagaactacgagcccggcgtggtcagctcggtctcggttttcacgccctataaaaacggcatcctcctgcgcgaactgccctccaagatggagacccttcgcgtcgagacccgcgacatcaaggacatcaagcagataaaagacgacctggagcacatgctcaaggtctccctcaacaagccctttcgccagcgcaaggccgtctattccctggtctatccgctcatcgcccccagcatgaccctcaaccaggaaacgacgcaagcccgcaaggccgagatcgcccgggccgtggagccgctgtactacatcatcaaaaagggcgagatcatcgtgcgccagggcgagcgcgtgggacccatccagcagctcaagctccagtccctctactcccaccgcaaaggcccctacaacctgctgcgggccacgggacttttcggcatgtgcctgatgtttctggccgtactctacgtctccctggagcgggccgggatcaaacgcgtgcgcagcaccgactgggtgtttctgggcgtggtgctgctcatcttcggcatgttggccaaggtgggcgacatggttaccctgccgggtggtggcgggttgccggaggcgacacgctcaatctacttcgcctacagcctgcccatcgccggcgcggccggtattttagcgctgtttttccccaaacgcctgtgcatcttcaccagcctcatcctgtcgtttctggccgccaacatggtctacggcggcatcggcgccttttgctactactttgtcggctccatgatctacgtctacctcatcaaacgctccgagacccgctcccagctgctcaagtccgtctttccgctcttggccgccctgtgcgtcatgtggtgctcggtcaaccttatggacttaaatgacccgtcggtagccggcgcgggcctggccttcgttgccctgtccgccttcctgtcgcttttggccgtggtcggcatcgcgcccatcatggagctcatcttcggctacacgtcgcgtttccggctcatggagctgctcaacctggaacagccgctgctccaggaactcatggtcaaggccccgggcacctaccaccattcactgatcgtctccaacatggtcgaagccggcgcccgggctatcggagccaatccgctgctggccaaggtcgcggccctctaccacgacatcggcaagctcaaaaatccccactatttcattgaaaacatctcctgcaaggagaaccgccacaacaagctcgcgccgtccatgagcgcgctaatcctcatatcccacgtcaaaaaaggcatcgaactggcccgtgaacaccgcctgggacaggccatcaccgacctcatcggccagcaccacggcaccacgctcattgcctacttctaccacaaggccaaggaactggccgaggccaagggcgatgatcccatccgcgaggccgattaccgctatcccggccccaagccccagtccaaggaagccggcctgatccttttggccgacgccatcgaggcctcaagccgcaccctggtggacccgacccccagccgcatcaagggccatatccaaaacatcgtgcgcaagatctacaccgagggcgaactggacgattcccagttgacccttaaggacctgacgttactcagcgacaccttccagcgcatcttgaccggcatcttccaccagcgcatcgaataccccagcgccaaaagcccggagaaaaacggcaaaacccgcgaggaaacggcctgcgccgtggaccccaaagcggcggaacacgccgcgtgatcggccttgcccggggcgtcttcgcccccgacctgccggcctcgcgtccggagatcgacgccctgtgcgacgcgctgctcgacgccctggacctcgacggccgggacttcgatctgacccttgccgacgatgccgccatcgccgccctcaatggcgaattcctggggctgcccggcccaaccaacatcctgagctttccggccgaggaccccgaccggcccgactacctcggcgaactggcgctgagcctcgacgccgtgcgccgggaagccttcctctacggccagccgccgggactgcacatggcccggctgctggcccacggcttcctgcatctggccggcctggaccacggaccgctcatggaatcgctgacggagaccgccgccgaaacggcggcggtgagactgggactggactaagggaaagcggaagaggcctcgggagtccgggggactcagtcccccggacccccgacatttttgggcggcgttccctgcaggcaaggcctacagggaacgccgcccaaaaacatggtgaagtccgttggcgtcaacgccaaccactttcggcttatctgttcctcacttccgcccgacgtcgtaacggcatttaccccttaacccatttggggggtccgggggccttaggccccagccgccggaggcatccccctctccttcttcctctttcccgcctagccctcgcggcgcaggccgtcgatgagggtcgccagacgcgaggcggagttggagagattgtccaactccgtttcggcatcagccatgccctgagcggtttcttcggcgatgagactgatgtcggccagggcgcggttgatctcttccgaagccgtggcctgctgctgcgaggcggtggctatggagcgcacctcctcggtggcggtttcggccatttccacgatgtgcgtgagcgaccggccggcgttttcggccagcttggtggtttcgtccacggccgtggccgccgcttccatgccggccacgttttcccgcacgccgctgtcaatggccgagaccaccgaggccacctcgcccgtggcctgcatggtcttttcggccaacttgcggacttcatcggccaccacggcaaatccgcgtccggcgtccccggcccgggccgcctcgatggcggcattaagcgccagcaggttggtctggtcggcgatgtcggagatgacgccgaggatggccgagatgcccttggcccgatcgcccagaacgtcgaggctggtcttgaggccctgggagaggccgcgcacccggtcgatggagcgggccacctcttcggtggcggacaggccttcgcgcgcgccgtcccgggcggcccgggcgctctggctggcgcggtcggcgttctgggccacttcgagcacggtggcgttcatttcctccatggccgtggccgtatcggcggtgcgttcgtgctggcgcaccgtgccccggttgacctgggccacccggtcggtcaaggcgttgccggcccgggccacggcgtcggccagatcctccagccgatcagccgcttcggtcagaccggagcgccgggcctgatcggcctggcgcgtagcctcctcggcggcctgccgctggctctgggcttcccgtaagtgtttttcagcctcggccgtgcgggcttccacggtggcgaaggactggcgaagcttgtcggccatggcggccatgtcggccatgacgccgcagcccttgcctttggcgacgcaggtcgcgctcacggcatcgaatcgtccggcggccacgtcccgggccacggcagccacttcccagggttcagccccgagctggcggcggatgttgcgggagacgaggacggcgcagacgacgcctacggccagcgacaggcccaacagcaggtattgcagccgcaaatcgttttcgagcttgtccaagatgccggccacctgggtgtccacggcctggaactggctggctttgaggggggcaatgcgcccggccagggcctcggtacgggcgtcgaaatcgcccatcatggcgttgccggcctcgcggccttcggccacataggccttggacatgcgcttgccgacgtcgtacatggcctcgaaatcgcgcagcacggcagcggtttccgcccgcagcgcctgattgccggtgcgctcggccagggccgcgaacttggccgcgccggcccgaaaggccccggccgccttctcggcctcggcaaaaccgtcgtcctcgcccgtggccgagacgtcggtaagccactgctggacgttgacggcctcgaattgcatgccggcggcgacgtcggccaggggaagggcctgggagcgcatggcctcggcccggtcctttacgttggccagggaaaaggtcatgacgaacgccccgacggtcatggccgccagcaccaaaccaaaacccagccccaaacgcgccgaaatagagaacttcatggataccgccttgcggattgggctgccggcgggctggggacacgcatcgcatcgccgtcgccgggcctggattttgagttttactgttacagaccgttaaggggcggggtcaagaccatggcaagaaacttttccctgggcggacaggacggcccgaatttcgacggctgcgtgccgacctttgacgcgccggtgcacgtcacggcccgcatccaggccgaccgcgccccggcggtggcgctgcttcacggcctgggcgattcccggctggccttcgaggacgccttcgccacccgctatctggccggggcgagtctgatcgttccggacatggccggccacgggggcagtccggccgccctggactattccatggaggctgccacccggcgggtgcgccaggtgcttgaccacctcatggagcaccacggcctgcgcccgagccgcctctatcttgtagggcactccgtgggcggcatcccggccacgtttttttgccgcgacgccgcccccggcgaagtggccgggctgatcctggccgaggcctcggtgacgcgcttcggggcctttgtctcggcccatgccgaagcggctcggctgtcggggcgttttggcgagtggtacgcggagtttcgcgaccagaccatctttcgggactatctcggcaagttcccgttttgccgccactactacgcctcgctgcgcttttgccgcgaggaagcctttctccagaccgtgctggccgtgcgccgcacctcccgggcgctgcccggcaaatggagccacgccgcaggccaagcccttgccgccctgcccatccccaagctctacgcctacggccgcgacgtggccccggaaacccgggcctttctcgacgaacacgccgtgcccacccgccccttccccacggactgccatttcctcatgcaggccatgcccggcgaattttacagtatgcttggcgaattttgtagttgaggggagggaaaaggcctccggcagccgggggcctgaggcccccggccccccaaatgggcgtcgtggatagctttgccagatggtgagcgatgcagccgccaaggccttgccagagcggggcgggcggggcacagtcggggcaatgtccaccccagccaaggagtcccgccatggacgccttccacgtggccctcaccgatgcggaaaaagcctttctcaaggatctcgtccggctggtcatcgccgccagactggccggcaagccggccaacctgcccgcgccagacagtgaaaccctgcgccgccgcttcggggccttcgtgaccctcacccttgatggccgcctgcgcggctgcatcggccacatcgtcggcgaccagcccctggtcaaaaccatcgccgccatggccgaggccgcagccttcggcgatccgcgctttacgccgctgacccgccgggagttcgaccgcgttgccatcgaaatctccatcctcggccccctggaaccctgcccggacccggcccaagtggtcgtcggccgccacggcctgatggtgcggcgcggcgcccgctccgggctgctgctgccccaggtgccggtggaatggggttgggatcgggaaacttttctggaccacacctgccgcaaggccggcctggaaaacggctgctggcgcgacccgtcggccacgctgtactggttcgaggccgaggttttttaggcggaacgggaagagagaagaggggaatgcctccggcggccgagggcctgaggcccccggaccccccaaatgggcaaagggctcggtcgctggtcaaccaggcagaggcgttgatgatgtccctcggtcggaccggcaacgacgcagcttccccggcaaccaacgctttgccgatatatggtcatttttgcgcgccgcgactcccgtttttgtggaatcgcggcgcgactgttttggggctgcctgtagaccgcctgaaatagtttactttttgtgattgtctccattggcacgttcctcgcttgaagaaaagcagatgtgggaacgccgccgtcagcggacaactggaagagggagccgacatgaaacgcctgctgcttatcgccgccatcgccgtcctgggagcgaccgtgtacgtggccgatccgccgcgtctgacagccaaggagacggctgccgcaggcattgtcgccaagactccagccgtccagagcgaggtggtccggctggccgaggccagcctgctgctgcgccgccagggcgaaccccggctcgccgcctatgatcagcacgccgggccgcatccacagcggcttttcgagagcaaatagcgacacggatttgggagggcaggcgcggcggagggttcgccgcgccggaaggggacgctttcgggcgtccccttttttgcggcattcccgtccgcagacgaccgccaaagcgcggcggcaggcatgtttgtggcctctggcggcggcctgcccgccctgctccagggaagcaaatcccgctaggggcacagacggccccgccgtctctgacggcgtttgctgcttgcggccagggactcagaactcgccggacggtccagcattgcaggccaggaaggggcaaaaggccagggcggtttcggtgaggcgggtttgcgtcccgactccggcgtagagggccaggggcgcgtccaggatcatgcccggaccgccgtttttgcgggcggccaccagcactagcctggccggcgcgccggcgcgcggcgaaacgggcagcacgcgcttgaccacaagccgcttgtccgccagggcggcaaagaccaggggcaggcgctcggccagatggatgcaggcgaagaggcctttgttggccaacagatagctgccggcggcggcgaaatcggtcatgtcgccgtccgtttcgaagcgggcggcctcccgggccgggccggaaggccggcggcccgaggccgggtcgcggtacggtggattgcaaatgaccagatcgcacgattccggcaggcagcgggcatcttcacggataccgcgcaggtccacggccagggccgtgaagcgctcggccaagccaaggcgcgcggcgttttggccggcggcccggaccatgtccgggtcgcggtccaaccccaggcaggtcgcggccggatcggccccggccagcagacagccaagaccagccgcgccgcagcccgtgccgagatcggccgtccgggggccggcggccagactcgcggcaaaggcagccaggagcagggcgtcggaaccgaaacgaaagcccccttcgggctgggccagcccgcgcgggaaggcctcgcgcgcggcctgcacggcgtcatcctcatattccggcatcaatcccatccacggcttctctggctccccggccgacagagagcaactccccgtcgaaaaccccttacaactttttcccatgcggggggtctgggaggggcttagctcctcccggccgccggaggcactcttccctcttccttttggctggcctttttggcccgcatgttgaggagttcgaccagcagggagaaggccatggcgaagtagatgtagccccggtctatgtggcggcccaggccctcggccaccaggaacacgccgatgaggatgagaaacgacagggccagcatctgcaccgtggggtggcgcgacacgaagtggctgatggcgtcggcgaaaagcatcatgaccaggacagcggcgatgacggccgccaccatgaccacgatttcgccggacatgcccacggcggtgatgacggaatcgagtgaaaagacgatgtcgaggatggcgatctgggtcacggcggcggcgaaaccgcgcactttcgcggcgcgcttttcgtcctcatgggccggctcgatcttttcgtgaatctcgaaagtggacttggcgataagaaacaggcccccggccagcaacacgacgtcgcggccggtgaccacgtggccaaggacggtgaaaagcggcgcgaccaggcccatgacccaggtgatgccgagcagcagcaggatgcgggtgcccatggccagcagcaggccgatcttgcgggccttggactggacctcggccggcagggcgttggagatgatggcgataaagacgatgttgtcgatgccaaggacgatttccagagcggacagcgtcaggaaagcgatgaggttttccgcggtgaaaagggccatgggcgttgctcctgggggatggcttggtcgcgtcggaagctgtctagcaaggggccggggtttgtgtacagcagggaaataacgggcggccggcgctacccggccctggccacgggcagttcgtcccagaccgtggtgtagcgcggggagcggctggcctggcgcatggcccagggcttgtcgatgccgcaggcggccggagccagggcgccgtgcccccatttggcgttgacggcgtccagggcggccatgaggcggcctttccgggcatcctcttcggggggcgcgtcgaggagcgagcgttggcgtcggccgcccggctccaggccaagcaggatcaccccggctttcttgtagcggtggccgggccgaaagatcgtctccagggcctggcgggccgccgtgatgagttcgccggtgtgggcggtggccgcgcgcggggcggcgaaggcggcgttggcgtagggcgggcggccgtccttgtcggcataggtctggacgtaggcctccacccctgaggcgaccagcccccgggcgcgcagccgggcggcggcccgggcggcgtattcggccacggcttcggccagctcgtccagggtggtcacggcccggccgaaggagcgcgaggacatgagcgtacgggccggcggcggggcgtgctccaggtcgatgcagggctggccgcgcagctcaagaagtgtatgcaggccctggacggtcatgcgctttttgacgaaatcccggggcagctcgcgaaacgccagggccgtgcggatgccgaaggcttccagcatggccgcgtggcggcggccgatgccccagacgtcttccaccggcgtggcggccaggacggcgtcggtatcggagcaggcggccagatcaaggacgccgccgctttccgggcgtttcttggccgccctgttggccagcttggccagggtcttggtgggggcaatgcccaccgacaccgggatgccggtccagcggacgacggtctcgcgcaggctgcgggccgtggcctcgggaccgcccggcaggccggccagatcaagaaaggcttcgtcgatggaatagacttccatggtcggcgtgaaccgggacagcgtggtcatgacccgggccgacatgtcgccgtaaagggcgtagttggaggagaaaacggccacgttgtggcgcgtgaacagctcccggcacataaaggccggcttgcccatggggatgccggccgccttggcctcggccgagcgcgcgatgacgcagccgtcgttgttggacagcaccacgatgggccggccggcgaggtggggcgcgaagacccgctcgcaggaggcgtagaaattgttgcagtcgaccagggcgtacagcgacggcatggcgatcacgctttatgaatgatgtaggtgaccacgccccagaccataaacgaggcctcgggcgcgacttccacagcctggtagtccgggttttccggcacgagcagcagtttgccgtcgcggcggcgcaggcgtttgacggtcagttcgccgtccagggcggccacgacgatggagccgtctttcgcctccagggcccggtccaccacgaggatgtcgcccgaggccacgccggcgtcgcgcatggagtcgccgtccacgcgcacgaaaaaggtggctgcgggatggcgcacgaggtgttcgttgaggtcgattttcttgtcgatgtagtcctcggccggcgaaggaaagccggccggggccgtggccagatacagcggcagctcaagcgcggtcttcggctcgaaccccaggatcgtcaaggtgggtcgtcccatgggggcacggtacgggagcgccgccgcgctgtccagacggcacgagcaggaaggtgaaagcgggaagagagcctccggcggcctcaggccccggactcccaaaatgggttaagggggacggcgatgacgcggcggttgaggcgcgacggaatcaccatgttttagggcggcgttccctgcaaggcttgcagggaacgccgccctaaaatgtcgggggtccggggggctgagccccccggccgccggaggcatcttctcttttgctgactcagtttacgccgcgttcgatgaaaaacggggcgtatttctggtccgtgcccttgatgtgtcccaccagccagttcttgaggaaattcatgacctcggtggtcagcgccgcccggttgtcccggaagtcgttgccaaaggcgatgaccttgtccacgaaggccacgtgttccttgcggtggttgaggtagcccggatacttgtactgctccatgagcttttcctcgtagccgaagtggtccaccgcatagttctgaagctcttcgagaatcgcctcaagctgatgcttgcccttgcccgagcgcatggcctcgtgcagatcgcagatcatgcgtacgagcacctggtgctggcggtcgatctcgctgatgtgggtggccagggaatcgtcccactgcagcaggctgccgccaatggaacaggccccgccggaaccgttgcccgaggctttgatggcggcaggcttggccgctggagcggggatggccgccggtttgggggccggggcatatttggcggcggcaggtttggccgtcggcaaggccttgggtttggccggggccggacgcgacggcggcagggcgcgggaagcggccgggcgtgacggcgcgatggccttggcggccggccgggcgacggccagggccggccgggacgcgccggcctcgccggtcatctggcggatggcggcgtcgaggtcgttcgtcagttcagacagggcatggagggcctgggacgcggcggcggcgtcctcggccgtgtcgcgggcgatgccgttgacctcttccacggcccggttgatctcttcggaggtggcggactgttcctcggaagccgtggcgatggactccacctgggtggcggtggcttcaacgatgccgacgatttcgtccatgaagcggccggaatcggcggccgcccgggtgctgtcctcaatgcccgaggcggcggactccacggcggcgatgttttccctcgcctgtccctggatggacaccacggcctcgccgacttccttggtggcggtcatggttttttcggccagtttgcggacctcgtcggccaccacggcaaagccgcgtccggcgtcgccggcccgggccgcctcgatggcagcattgagcgccagcaggttggtctggtcggcgatgtcggaaatgacgttcatgatgtggccgatgctgtctgcctgctggccaagacgcgtcatggattccttgagatcgaggatgcgccggcggatggcctcgatggacgttacggccgaacgcacgccggccgcgccggtggcggccttgtccttggcgtcggcggcgctcacggcggcgctggaggcattgcgggccacttccatcaccgtggcgttcatttcttccatggccgcggccgtgtccatcatccggtcacgctgctgggccgcgccctgccccacctgttcaatgcgcgaaagcaagccggccgcatgatccatgacgctctgggagatgccgcgcgccttggccgcgccgtctcccaggcgggccaacatttcggcggtgcgggtttcctgctcgcgggcggcagccaacgcccgttcggcgtcgtcggcatgtccggtacattccaggtttttggcttcgacagcggccaaggtgtccctgagggactccaccatgcgggccagggcgtcgcgcagcacggccagttccggcggatagtcgccggccggcacggcctgcaaatcgcctccggccacggctgcagcgtattcgcgcagccgccccaggggcgcgatgaccgcgcggcggaacatgaacagcaccgccaagcacaccacggcgcacagccccatgcccacggcctgaatggtcatgagcgtggacacgtcgtcctcggtctcggcttgaagccgggccacggccttgtcctgggccgcgaccatggcttccgaggcggccagcaggcgttcgggcgaaacggcatcggtcttggccaggatggcttcgacttcgacgccaaaaggtttgatcagccggccggcctcgtcgaggagtgccgcggcctcacggctggacgggtcaatggtgaacctcttgctgccttcatacgtgccgccccgggccagcagattttgggtcgattccagagcggatagccgcttgcgaatatcgtcggccaggccagccggcgcgccgccgcccttggcctggtgggccaaggccaggacgtccttggcgattctctgaacctgcatccgttgccggccggccagattgatgacaagaccgtcggagcgctgctcgctggtgatggaccacgtggccgcgaacatgcccagcgcaacgagaaaaaggacagcgacggaggcgagaatccgggcgcgaatactcatggatcgaaactccttggccgggcggcagctgaaaagcaatatcactagcccgacaaaaatgttcgagcatgaggttcgctcaggtgtcaatactcattttgatgaccgaaatagtgcggaagctccgcccaatatctcttccagttccgcgtcccgcaaggacaaccggcggcgcaggcgcgcgatttcctcaccgggatcgaacagcgggtaatcactgccgaaaaggatgcgttcccggggatggccgtcgaaaatgcgccgcaaggtagcgtcgtcgataaaggccagggtgctggacgtgtcaatatagacatttttgccgaccagatgctccacggcgtattgccaatggagatagccgcccatgtgggcggcgatgaccgtcagctggggaaaatcgcgcaggatggccgccaccttggccgggcaggagttgttctcctcggggggcaggcggtcgcctacgtgaagcatgaccacgaaccggccggacagcgcttcgaagatgggccacagcttgcggtcgtccaggcggaagccctggaagtcggcgtgaaacttgatgcccttgatgccgttgcgccacagccggtccagttcgcgctcgaagtccgggtagtccgggtgcagcgtgccgaagctgatgatgcgcttgtgttcgcggtggatggcgatggcccaattgttggccggaaccacctgggccggggccgttgccgcgttgtggaccacgaccttgtccaggcccgccttggtcgcgcgctccaaaagatcgtcgatctggccggtgccgacaggcgggatgccgtagtgcccttcaagctgggccagaaccttgtccgcgatcttgggatgataggcgtgggtgtggatatcaataaacatgagggaaaatgccgcgaaaaaggcgggagggttagaaggtgaacagctcgcgcagccaggacggcacgggcatgggccggccttggggcgaggtgcaggcgtggagcgtttcgcccacggcgagaagcgtggcgtcctcgggcggcccgaagacctgataagcaaaggtgaccgaggcccggccccactcgctgacggccgtgcgcacggtgatggcgtcgtcgtagcgggccgggcgcagataccgcacggccatatcgcgcaccggcagccacacgccgcgcgcctcgacctcgccgtagctcatgccgcgcacgcggatgaaatgcccgcgcccgcgctcgaaccagtggggatagtgcccgtagtaggcgtagcccatctggtccacctcgccgtaggagacggtgagcgccagccgcgagtcaggctggggaaagtcttcaggcttgaggatcagggccatggcgtctcgttctcgcgtatctcgcccggcgatcagacgtcgccagcgtgtcgcaaccgttttttggcgaaatgcgcccggaaagtccggcgcgtcaagaacgggtccagtccatggcccggcgcagcaactcgtgccccgcttccacggccagcccggtccccgcagcttcggcctcgctaaaacccgccgcaccggagggtattacgcccggctgccagaaaagaaaaggcacgggatcggcggcatgggtgcgaatggcgatgggcgtcaagtggtcgcaggcaatgacgaaggccgcgtcgtcgcccagggcctcgaccatgggcgcgacaatgcgggcgtcgaaccgggccacggcctcggtcttgccggcggcgtcgccgccatggccgcactcgtccggggcctcgacatggacgaagacaaaatcgccgtcctttaaaaacgccagcgccgccgccaccttgccctcgtagttggtgtcgagcagccccgtggccccgggcacgtcgataacagccatgccggccgcccgcccaagacccttgaccagatccacggccgagaccaccgcgccgcgcaggccgaaggtcgcggcgaaatcgggcaaggtcagcgccctcccctggccccagggccacacggcgttggccttggttgcattgtccggcccggccagcacggccgccgccttggccgcgaaatcaaaaagcgccggggcgcggcgaaactcggccaggtccggggcgatgggctggtcggtgatgtcgtggggcggacgcacgtaaacacccgcctcctcccggccggccgcgcccttggccaccaggatgtggcggtactgcacgccggcatgaagctcgtagccctccggcaggcaggtcgcggccagcttctcgaccagggccgtggacgcctgggtggcgatatggccggcgctgtagtcgcgcatgagcccggcctcggcgaactggctcaccgtgacggtgttgaggcggaaaaccacgtcgtcgggcgcgaccggcaagcccatggccgccgcctcgatggggcctcggccggtgtggttttgggccggatcaaagcccagaagcgacatgttggccacgtccgaccccggggccatgccctggggcacggtgcggcaaagccccaccatcccctcccgggccagccggtccatgaccggggtggccgccgcttccatgggcgtgcgcccgcccagggaatccacgggcagatcgcccatgccgtcggcgatgaggaacacgagtttgcggggcaagggggacggagaggatgaaggagatggaacggacaagatgatgcctccggcggccagagagaaactttttgaaaaaagtttctctctggactctcttcaaaaacttttaacggggcatgccgaacacatgcaccggtgattacaatacccggaaatggaccgtgccgggcttgatgaagggcatggccccggtgtcggccagcacggcgtcgatggcccggttgggggcctcgtgggtcaagaacacgatggacacgtagccgtcctcgggttcgcctttctgcacggcctggcggatggacacgccatgctcgcccatggacttggagatggcggccatgaccccggcctgatccttgaccgtgaaatggatgtagtgcggggtgacgaaatcgtcggaagcgaccagctcggcctcgggcaaaggctcggtgcgaaagcccgtgttgttggggatcatgccgtcccgggccagggccaggatgtcggccaccacggcgctggccgtgggcaggtcgccggcacccttgccgtggagcatgatggggccggaggcgttgccttccacccgcacggcgttaaacgcgcccctgacgctggccagcaggaagtcctcatgcacgagcatgggccagaccccggcggcaagtttgccgtcgcagtcgcgcacctggccgatgagcttgatggcgtagccgaactcccgggcaaaccgaatgtcctcgggggtgaccacggtgatgccctcgacaggcagcttctccaggggcagattgcacccgtaggccagccggatgagcacgatgagcttgtgagctgcgtcgaagccctggatgtccagggtcggatcggcctcggcgtagccgagctcctgggccttggccaaagcgtcggcaaagggcaggcccttttcgctcatgctggagagaatgtagttggccgtgccgtttaggatgccgatgatgctctggacgcggttgccggccagggacgagcgcagggtctcgacaatgggcacggctccggcgcagctggcctcgtagtagaggccaagccccttttcggcggccagggcgaaaagctccggcccgcgcttggccaaaagcgccttgttggccgtgaccacgtgcttgccggcgttaagcgccttggcaataagcccgaaggcggcgtcgatgccgcccatgagctctaccacgatgtcgatgtccgggtcggtgaccagggcgtcggcgtcggtggtgaccagtacctcggggccaagcgtcacggcccggggcttggccaagtcgcgcacgagcacggtcttgacggcaaccgaccgacccaggcgcgcctcgatccagtcggcgtttttctccagcacggccaccaggccggacccgacggtgccgagtccggccaatccgatgcgaacaggggctacggcagcgttgttcatccggaaagcgccttttttatgccgcggacggcctgattgatgcggtggcggttttcgaccagggcaaaccgcacgtagttgtcgccgaagtgcccgaagcccaggcccggcgaaacggccacgccgccctcgcgcagcagcagcttggagaattccacggacttgagatgctggaagggctcgggaatcttggcccacacgaacatggtggacttgggcgcgggcacttcccagccggcccgggccaggccgtcaatgagcgcgtcgcggcgctcctggtggacgtccatgatctcgcgcacgcactcctgggggccgtttagggccacggtggcggcgatctggatgggctggaagatgccgtagtcgagatagctcttgatgcgggtcagggcatggaccatctcggggttgccgcagcaaaacccgacgcgccagccggccatggaatagcttttggtgagggagaaaaactccacgcccacgtctttcgcgcccttggcctgcaaaaagctcggcggctggtagccgtcgaagccgaagtcggcgtaggcgaagtcgtggatgaccatcatgtcgtgttctttgcagaattcgacgatgcgctcgaaaaacggcacgtcggccgtgaccgtggtcgggttgtgcggataggaaatgatgagcagcttgggctggggccaggtctggcgcgtggcggccagcaggtcctcgaaaaagtcccggtcgctgcttatcgggatgcgccgcacgtcggctccggcgatgatgcaggagtacggatggatcggataggccgggtcggtggcgaaaaccacgtcgccgggcgagagcatgacgagcgccaggtgggccaggccttccttggcccccatggtgaccacggcttcggtttcggggtcgatgtcaacgtcgaagcggcgcttgtaccaggccgagacggcgtttcgcaggcccttgatgccacgcgatgccgagtagcggtggttcacggccttttgggcggcctcgacgagtttttcgacgatatgggggggcgtgggcaggtcggggttgcccatgcccaggtcgatgacgtcctcgtttcgccgccgcatctgcattttgagctcattgacggtggcgaagacgtatgggggaaggcgctccatacgcgcgaactttttcatgccctggactccttttgagggggctcgttaatgcgaaacgggagcatatgcgcctgcccggccccctgtaaagagcgtatgaggtcaaaggcttggggaaaagcagtttttttccttgaccgcgagcgggcaaacgtttacctcaccgttttgcggagaggtggccgagttggccgaaggcgctcgcctgctaagcgggtaacggggcttaaaccctgttcgagggttcaaatccctccctctccgccagatatttagaatcattaagaaaagccgtccaaatttgggcggcttttcgcttttttcgacctgccttgcgagtagcgaatcccgcgtcgacctagttgtcgacctacccttccctcgaaaaaaatttcaccccccgctaaaccacgcccctctcctcaccctactcagccccaccgccatccacccagggtatcctcacaccctatggatggaacttccatttccaggaatgacatcctaagaattcggtgacacggccctcctctgcccggtttgcccgattttgaacttatccttctccggggttttgacagaggggttcaccaaagtgcatagtggtactgtggtttgcagaagggactcgcccaaaacgctggttgttgatctaggtttttgaaagtggcctggcactgaaattattatgaaaactggagagtggccctggagaaacaccattttcctgagtttgactcgtatcataaaaaatataacaaaagaatattttatattggtccacaaaacatccagatgcactagaaatgactacaaaagatcgcagccaaaacaacagcaataaagctttcagcaattaaatacacttctgcaaagaacagtgcttttacctgagcacgtgagacagcgacttacgcactggtgcgcaatactcaaaaaaacgaagcacatcaaaaaaaacgggttttgccatgaaaagaatcacaataaaggccatgctagtcactttcgccttcaccgcttctacttcactagttatgtcactattgttattcttgaattacgaacacaaaacatctcaagaatttgaccgaatcattaatcttgaaaacaagcacagcatattccttcacgaatcgtgggcaaacggcctccagacagagcaagccatcagaaacataatcttcaacccgaaagatcaaaaagcagctgaaaattataaaaatgctgactcttattttacaaaagcaattacatctctcatcgacataagcaaaggcgatcaaacaaatatttacaaagagctttcagcaaaatggagcaaaatcgcgctgacaaagagtgaaattataaagctagcgacagaaaacaagcaaagcgacgccatagccatccttaacagcaccgaaacgcctcagtggagagacataaaggcaatcatactcaaacaaatagacttacaaaacgaggtctttaaaaaagcacttgagaacaacaaaaaaacaaatgagtcgagcaaaataattttcatatctatcgtcgcatttatgcttatatttgtagtcatagcatcagtagtcataacaaaatcaatcaactcaccactaaaaagcttaggattattttcaaacaaaattgcatctggcgattatggtgcagttattgatgacaacttttgccctgaatttgaatcactaaagaaaaaaacgctagaaatgacaaacaaaccaaaggaaagcctaggattttctcagagtgtaatgcaaggatatcgccagccatttttaacaatagacctagatggacgaattacatccgtaaacaacgcggcccttttgatgcttgagtcggacttacccgccgaggcgtacattgggaaaaaagccggttatttattttacaaagacgaatcgagagaaacaaacatacaaaaacttatcaagtcaacaaactggagttcgacagaagatgtttcgctaacaacacagaaaaacaacaaattgagtgtcaaagctgacagatgtcaacttaaagatcttgatggaaatgtaacaggaggaatagccacctacacagatttaacggatatcaagtgtagtgaaagtcaggccattctacaatccgaagatatgcgccgcgccgctacagaaacggaaaacatcgcttcgggtcttttcgaagcagtcgaaagtctttctaatcagatcaatattgctgctgacggcgcgactacacagcgagagcgttctgaaacaacatcacttgcaatggatgaattgaaaaacatcatttctcaagtcactgatcaagctgacatagctgcaaagaatgctaatattgctcaagaaaaagcgcttgaaggatcaaacatcgtaaaacaatcagttgaagctatacatgaagtttcattaacagcggcacgactcagcgaaaacatgcaatcactggaagcgcattcaaaatcaatcggagaaataattggagttatctccgacatagctgatcaaacaaatcttttggcgttaaacgctgcaattgaagccgccagagctggtgattcagggcgggggttcgctgttgttgcggatgaagttcggaagttagcagaaaagaccacacacgctactcttgaagtagaaaatactatccgagccatacaagaatcaaccaaactcaacataagtcaaatgaacaatgcaattaaaattatagatggcgcaaccgatctcgcgaacaaatctggaaattctttaagtgaaatcgtgagcatcgcagaaactactgcaactgggtcacaaaatattgttgaagcatcgcgagaacaatatgtaaacgctgaaaaaattgcacaattagcgaatgaggttcgtattactgcagacgaaacagaccaaggattacaccaagcgtctagtgccgtagaacaactcactgaaatggctagggctttaaaaaacctggttgacaagctcagtcggtaaacaaatcatagcgttttggcgttagcattaaaagctatatacaggcttaacattctggataacctaagcggactgtccaacgaatacttttcaaagcttgttttcagcatccatcccatggccaaaatcaacagttgttgagaagtgtggacatcggcgtagtatatcccaatagaaaaaactacgtttgcgccatgcggctcgcgagaccgattataaaacatgcacaattataaccattgcgaggttatattaaaatgcacgaagactatattacactggcgaaaccctttatacaagctactcaacacgtaatctcaacaatggctttcgttcaagcaactcctggcaagccatacgtcaaaaaaggattaactgctcctggcgatgtatcagcaattatagggttcactggagatagaaatggaacgatggcactatcattcactaaaaaatgtgccattttcattttaaaaaatatgctaggcgacgatattcaagacatcgtccaggacatcaaagaaactgtcggtgaactcactaacatgatatcaggtcaatcaagagcaaacttatctcaaatggggattaatttacaagcgtctatccctaccattatcttaggagacaaccacactattgaacacatgaaacaatgcacaatagtcacaaccccatttaatacttcaagtggtgatttttttgttgaattttcgctggaacaactcgcttaatctacaacacagctacacgtacttaccaaagccacacacagggactttgtaaaaaatgaaaataggcgacatcaagatcttagtcgtggacgatttttcgactatgcgaaaaattatcaaatcaatgttaaggagagttggaattaaatccattgatgacgctgaagatggaaaaattgcactaagttatttaaaatcaaaaccgtataatcttatcattttagactggaacatgccaaacatgtcggggctagaccttttaagatcgatcaaaagcgatgaaacactaaaaaatgtacctgtactaatggtcacatctgaagcaaaagaatctcaagtcataatagctgttcaagctggcgcatcaagctacatcgtaaaaccattcacagaagcaacacttataaaaaaactttgcactattcttaaaatagaagttcaaacttagaaaaaacgcaatatacattagattcattgccaacagggctggaggccagttggtgtcatggattatagtcatggattctagaaaacagtaaaaaaagcacaagataattgaaatattatgacatcattattttacacaaataaacttatccgtcattttcctcttggcagccgactcatctcccgtattcttcaatagcgtcatccaggcagcctttaatagcatctagatcctctttaaacaattcggccatttcgctttttgaagctatatttcgaatcaacaaatacaaatctttcattttcagcaaatctctcactgtttcccagctaatcgcttcataagtatgaaacaacaacctatttgattcgtcaaaaggatgaagacttagcaggttgcacttaaaattatcccaagcaccttgaagttctgaaagagaagtttcctcgtatcctggttgttcagtataaaacgacatatcaaagcacctttgcatacatgcaggcgattgtccttgagttcttacacgactatctttctgcaaatcaattcaaagcatttcattagcagcatccattcaggtccagcaaaggtttaagaccggagccggcttcatgccatgcagttggaaccagtgtcctacattttcgaaagtcctttctccgtggactatctttaaaagctattcacggttaagataatttttaaaatccctcccagttttaaaaaaagggattttcttcggctttacttccactttaattcctgtttttggatttcgaccagtataaccatcatattctttaactgcaaaggaaccgaaaccacggacttcaacacggtcaccattgactagagcttgcttaatagattcaaaaaaagagttcacaaattcgacagcaaattcatggtcgagattatacttctccccgactgccttaatcagctcgcccttgttcattttcagcctccatttcgacagagtatgaattattccccttggttgcaagctagtaactgcggcccactgctttttcgtcggcagtgatttttttcccaaaaatcgaactctgaaacgcaagcttcctgttactagcctactagctgttagagtacccccataaccggagggaaacaagcgttcggtggaaacttttaaaccatttcatacttgacaaggaagaaaattatcccctatctgtcggtgattcattttcattgaagaacaaatccaccccgtgaggaaacaatggaagagtatatccagagcgcccttgatatcgtgaaggcccaggctagcgccaggcccatgacagaagatgaaatcatcagcatggtcaagtcagtcgccaaaggtattgctgctgtcagcactggccagcttgctaccattgatgctgatgctgccgcaccggccatggacccgaaaaaggccatcaaggaagcatccatcacctgccttgagtgcggcaagtccttcaaggtcatcaccaagaagcacttggcctcccatggcctcacctccgaggaatataaggcaaaatacggctataagaagactcaggcccttgcgtgcaagtccttggctcgggaacgccgcactaagatgaaggacatgaaactctgggaacggcggaccaagagcaaagctgaatagcaatctttaccattcgatgccgccccgcctgatgcggcttccccctctgccccagtgcgcctccccgtgctggggctttttttcttgacgaacccgtatgttaccggacaaccatcctcgaaaatggagggttttgcttaccgggaccaagttcggggacacgcccggtcctgctgccagttgtccgcctgtacccaacgcctgggctaaaaatcggcaaatcgccgacaggtcttgttgaccgccctaatggagccagcgatgtgcacccctaatggagccactttgggtggcgattacggggttcggacgcatcgaaaagttaggtgttttcctccgcaccggcaacgaggtttttgagcgccgcttcctctcgggagcttcgatagctccttccttcaaggatgactttgtacgccccgtgtctgatccggtccaaggtcgccgctccgagcagtttgttgttgaaggcctccccccattcggagaagtccagattgctggtgataaccgtagcaaagcgctcgtaacgctcggcgatcaggtcgtgaaagtcttcatcctccgaggacttaaagggtttcaatccaaagtcgtcaatgatgagtacgtccgttttggccagggcggacagtttcctatcgtaggaattggtcgctttagccgcttggagcatccccaggagcttgctgacaggcgtaaacagcacctcgtacccttttcgggcggctgcatgaccaagggcctgggcgatatggcttttgccggtgccgcaggggccgacgatgagcaccggtgccttttcctcaaggaagcgacaggtggccaagtccaggacgagcgccttgttgatggacggattgtagctaaagtcgaagctttccaatgttttttcactgcgaaagccggcccggcgtacgcgcaacgagaactttttctgttcgcggcgagccacctcgtcctggatcagcatggccagaaactccacgtgagacagaccatcctcgatggcttgcttattgcgtatttccatggagtccaagattccggaaaggcgcaactgcttgagtgccggctcgagcgctggcatagggttcatgatctcctcctttgtcattgaagaattcctcttaattctcggcaatacttcgattttcctttgtatatttctttcacctcctcatggaaaacagggcgaggcaaaacatcaaggcctttctccaggatccgtttgacggtgttatagtggggggcgtgatgatccaacgctcgacggcaagctgcttccagacgtttggccccgtacttctttttaaacgtcaatgtggcctgagctgcccgcagattgtccagcaccttatgggcaaacaaagcgtcaatgaattcccggcaggcaatgccaaccttttctgactgccttaggcaccactgcggatcgtgcatattgtaagcttgagcctcaggcggcaaatgctcttgcacggttgacttgctccccgggcgagacaggcgaggatggatggcaaccaactcgttgtcataaaagatctgtacggtcttttccgtggcgcgcagccaaaggaattggtggaccaatcgatatggtgcggagtagtagcaacgccgaaattcgacatgacagtttccgtgcaactttaccttgccccaaatagccagttcagtcgggacatcgggcagagatcgcaagacatgcttctctgtttcgacgaacatcgctaagggctgttccttggtggtgccatggttacggttgcccgccgtgctcatgacccagtccagcagctggtcattggcgtcccgtaagctgcggaagtcgcgtaacggcatgaagttgttcttgatatatttaacgccagcctccacccggccttttttctggggatcacgcggcggacaaggcgacaccaggaatccgtaactctctgcaaattcggcataagaacgctgtaccacggggtcatggtagcaggccttggtgatggcgcacttgggattgtcgatgatgaccctggccgggacgccgccgaaaaactcaaacgctctacggtggcacccaagccaggtctcgattttctggtcgcgcacgatctccgcatactgatgccggctccaagccagcgtcatcacgaagaaatgggtcttgataacttcgcctgtgaaagcgtcagtaatctccggtccggcaccaaaatccacctgcaccgcgtcgcccggggcaaaatccagcatcaccgtggccgccggagtgacctctttgatcttggcaatgaagcgcctgacacttgaatacgcacccgtgaaaccgtgcttgcgaatcagggcttggtggatcgtgcagccggcaacgccctgcttgacccagtcccggacgtcgtcttggaaggggatgatactggaagtggatggctgcttcgatgcccggccaggaaaaaacgaagcaaggtccgcgtcagcgggcacggacgccgctggattgagccatccttgcgattcggctgtctcacggacgtgggcgagttttctgcgccccatcaggccggtctttgcgatctgcctgtcggactcgccaaggcgcatccggacaagggcttgacgatactcgtacatctcgaacctccgattagacatcccgcgctcctcccgtttgtgaatcgggaaaaagtacgcggcgtctcgaaggtccgaaacccggtcgcttacggctgccctggctccattagatgatcacagaatggctccattgcctgatcaccaaatggctccattatgggagcacgccgtggctccattagctgagcacccagtggatccataggggcggtcgccgaggcgcggaactccatcaagggacttggcattggtcatttttccaaccgctggatacgtctagatctcctgcgaattatggttgttgctccaggctcgcacattctatgctcgcgccgccgtggcaactcctcctcccgtccaactcggaatcctgtcacgtccagccgactactcctgtgctcacgcgccactatgggccaactgttgtctagaaaggtagtcagaggacgacaccctggcatgctggctctgttgtcatggtaactgggcaaaaaaggacgccaccccctttcgctagtccactgcctctgttatgatttgatataacgtgggaaacccgagtcggcagggaaaaatatgacggattccgaaaagaccagcaggaggattgaatcgcaactcgtcaacttcgctcaaacaccgattcacgacaagggcttattccaaattgttttaagctgtttgcccatgccttatctacttgttgatgtcgacgagcgagtcattcaaacgaatcaagcttgccttgacatgctaaaaattgatggatctgtggaatcgtgctatgaaaaaaagttaagcgaagtcttttacaacgaccctatgcacccaactgtcgtaggcaagagtatttcagaaaataaaatatttagagacatagaagttcacactatagatcgccatgggtctgaactacaaatcgttgcaaacgtttttcccctctatgacttgaacagcacttgcataggcggcatgtgcatctatgtcgacaccactgaacgcaagagaacagaggaagctcttgaaagacgattagtggcgcttacgcgcccacttgacggctctgagggagtccaatttgaggacatgttcaatctggtcgatatccaacgcctccaagatgaatttgccaatgccacgcgtgtagcgtctattattacccgacccgatggaacgcccattactaatccgagcaatttttgccggttgtgtagagatattatccgtagtacagaaagaggtagggccaattgctttcgttcagatgccatgcttggaaagctatcgacttcaggaccaaccattcgaccgtgtatgagcggaggattgtgggacgccggagcaggcatttctgttggcggacgccacattgctaactggctgatcggccaagtgcgcgatgtaagccatactgaaaagcagatgcgcgattatgcaaaacggatcggggccgacgaagacgaagtggttgaggctttccaggatgttccgagcatgaccacagagcgtttcaggcaaattgcgcaagtcctttttaccctgacaaaacaactctcttcaatggcataccaaaatgttcagcaggctcgattcatttctgatcgcaagcgggcagaagatgccgtcaagctaagtgaagaacgctttaaaaaattattcgacaacgttgattccgtggctgtccagggctatgaccgtaacaggaaagttatttactggaataacgccagtgaaaaaatttatggatacaaacaaaacgaagccattggtgttcatcttgaagacttaataatacctccggatatgcggcttcatgtcgtcgaagccatccgtcaatatgcagaggaaggcaagcccatcccggctggtgaattgcacctgatgcgcaaagatgggacatcagtcccagtctattcaagtcatgtcatgcaaaccacgagcaaaggtgacattgaactattttgccttgatgtcgatctaacagagctagatgttgtaaggaaagaattgatatcagcaaaggacaaggctgaagcatcgagcatggcaaagagtgaatttcttgcaaacatgagtcatgagattcgtacgccactaaatggcatcctgggcatgcttcaacttcttgaaacaacaacaataagtgacgagcaaaaagaatatctccttggagcgatcaagtcttccaagaggttgacacgacttctgtctgacatacttgacttatcaaaaattgaatcgaaacgcaccaccattgatcaagttgaatttgacatagaagaggttgtccgatcagtttctgaagcgttttcgatttcaatcaaagaaaatggactatctttcaggacagttcttgacaacaatattcctcggcgactaattggcgacgaaacacgaatgaggcaaatactattcaatattgttgggaatgctataaagttcactcctactggaaaaattgaagtggaactgtcacttctttcgcatcacaccaacaagtcatgtcgcgttcttgtgtctgtagccgacacggggataggaattcccgccgacagattgaaggatatcttggagccatttacacaggtggatggctcatatattcgatcaaaacaaggtgcaggtctaggtctagcaatagtcagaaaacttgttgcgcttttaggtggcaatatttgcatagatagcgagctaggtgcggggacaactttctatgttgtatttaattttcaatgcacgaccgaatcgtttgccgcaatagacaaatatggtcctgcatcaagggagagagttaatttaaattataatattctcgttgttgaagacgaacaaataaacagaatcgttacctgcaagattctaaacaagattggctgcaaaacggcaacggccgtcgatgggcagggggcgctagatatgcttgctcattctgattatgatttaattttgatggatatccagatgccaatcatggacggtgttgctgcgacaaaagccataagaagccttccaagatttcaatcaaagtcaaagattccgataatagcaatgaccgcgcatgcaatgctaggggaccggaaatcattcttggctgcgggaatggatgactatgtagccaaaccatttaagaacacggagcttattgaggcgatcatgagggtaaagggaaaagaattataatgagtctgttcagcaagttcaaagtccggctcagcccaaagggggtggggctaggatcgcgtccgcgtttggacatgtactccttgcatctgatggcaagagacgctctccgccgggccgggctagatgcgcgtgcagaagaactgcaccatcgcgcccttggtgtgtggtgcctttgggttaatgattgagttagtggaagattttgtggaactgaggtggccgcagatatcacactcaagcaaacaaatttatgcgatgaaaaaaactaccataatcttccgccatagtggtaatccttacgatctctacttaattaccatggcagcattgcgcaaggacggtctcaaggatcaggtgcgagaacttcagaagcgaagtctggacgctcagtcattccacgaaatgctgaccttggtgctggaatacgttgacgtggaccaagtataggagacgtcgtcagtgtcgagggcaatccgtcaccgtcgctgacgctattacctaaccggggatacgactccaacgcgtttatcgtcagtgattgcctttatctggctgcaattatacggctattgtgaacagctcacagtcttgtgatatgcaattatttatagatgaatataaattatctaaatacaataacattaccattcaggatctatagttgtcactccaaacagtgctacattatttttaccagttcctttgacgtcatacatggctttgtccgcacaatttaaaagatcatcggacgacatcccaacttgatattcagcaacaccaatagatactgtaaaccgaatggaattttccgctagctttccattaagccgtggcctaaattcataattttgaactgccaagcgtattgcgtcagagtgtagcaaggcttcgtcaacagaaacattacatacaacaactagttcatctccaccatatcgcgcagcaaaccatccaaacttttcggaatgcgcacttataattttagccaaagtcctcaagacatcatcaccaacctgatgcccatgtgcatcatttacctgtttaaagttgtcaatatcgagcatcaaaagagcaagggaattattgtctgtctgattttgctggatagcactctttaggtatgattctagatatctgcgattatgaagtggcgcaaggagcggatcaacattaacagtttgctcaagaagccgagcttttctttcccactcattagccttttccctgtaatgcattaacatgtttttcagcaaacctttcagcctaggccttagagcgtccaagtcttcagaatccgaaagtatttccaaggtatcacgaccaaacgtatttatcaattttccacgttctttttctgacatcaatgattcatcaaggaactcattgacaactgatgccaaagaagacgtgatcttcttttgcgactcaagcttttcttcagccgagaccgtcacctgattgtttgctataaaaccttcaaggtcattaacaatctgctcaaaatgttgaggcgatggatcttttttcgacaacctctcaaacacatttcgttgcattgcggatttctgttcatcagtaaaaattgaaaagtttgcaaccaagttcctgacaaacaggacaacagcaagccatgacggtttacttccacatccaatcctatgcatttcggagcataattttttaatcgcgcacgagtcacttggacagttattcgacatatccttcctctacaaagtagcgattcgaaaatatattcattaacccaaacacactgtctgcacaagtacagtagcccggcaatacttaactcgtcgagaccgccagagggaggcctacatcagccaatatgccgccaatggacagctaacgagacagtggctagcctgccatcaagttgccaaagaaatgtgctaccatttcgctaaatataaaatatacgtcaaaacagctaacaacccagagctttgagtttatcattacacgctcctcctcgcaatttctcaattagtcgagccaagacttgagattgttctgacagagcagccactgaacgagaagagtgctgcatggtttcactcatctctgttgaaatcgtttcgatatgcgaaattgatcgactaatttcgtcgctagaggcagactgctgttcagctgctatagcgattgagcgcacttgatctgaagtggcgttaaccatggcgacaatctcatcaagggccttaccagagcggtcggcaagggccgtggcctgggcaattttctctaccgcgacgttgacatgccccacattgtttttagcaacctcttggacgccgtagatggcctgagccacttccttggtggtgatcatcgttttctcggcaagcttgcgcacctcatcagcgactacagcaaagccacgaccagcatcgccagctctagcggcctcaatcgctgcattgagtgccaataagttggtctggtctgcaatgtcggaaataacttctaaaacgcgaccaatctcttcagctttcttgccgagcacagtcatatctgcctttagttctccggcttggcgttctacctcagtgatgctatttactacatgagcgacaacttcaccgccttccttcgcttttatgcgcgcttgatctgaagtcgtggccgcattggatgcatttttggctacctccagcacagcggtattcatctctgtcatcgacgttgctgtttcagacacgtgacgggcttgtgattgtgctccgtggctggcatggtcgatttgttcgttaagttcttcagacgcaccgttaaccacgtccgcgacgtgagcggtctcctcagctatgcgaagaagtgtttgctgttgttctagcatgagttgttttgcactttcgtctgccgtcatgtcgatcataatgccgataactccagcgacattaccattggcgtcaaaaagtggagaaatagagtagtttaacggcacatcctgacggcctggacgggtgataactagcctgcctgtcaatggcctacgctcggccactacagtagaagttatggtttctcgttcttcaccataaaaagcggtagccacattaatagttccaattcgagattgatcgagcattaatatgtcagaaagaactttattgcagtaattaattatgttttttgtgtcgcaagtaaaaaaaggaacagatatcccatctagaacacttttttgatactgaatttgatctttaataacccccacagtggccgacaagtttgcagccaaccgtgccagttcgtcatttccactcacttgaaaaacagcactaaaatcacctgatccaaccgcatcactcgccctcgcaagaacacctaccttcttaattacagattgcttcataaataaaatcaaacagccaagtaggcccgtcattgaagcaagcgaaataatagcagtataaactttaaaatcgttcacggaatcaaagctagttgtaacatcttgagtcataattgtagcacccaaaataggtgcgctcttcccatggcagtgataacaagacggctcattcataatgcttttagcctcaaaaaatatcggcttctctccaacatgaagaaccgctgtttcaaccccttttttttcaagaactttagagattattgcatccgcacctccagaagcataaacttcgcggatatttttacgaatttgtgagtcaattgtgctgtaagtaattattccacgaaagtcgctcactgacatgttaactctcttgaattcatgggctatatccttgaacttttgcttggtcatctcatcgttaccttcagccataggcgtcatcatagctaaccgcgccatccgttccaagcgcgaacaggctaaagtcatttcagcaataaccccattttcttgaagccttgcagaaacaaaaaacagacttataaaaaatatggttgcgagaaaactcatcaagacgactatcttggcattaagggatctttttaaaaaattcatacgccctcctagaaagcgtcaattaatgagcgccagcgtatttgagaggtttaaatccaaaggatctaacccgctcttcattgtggcaaactttgcaactctctaaagttggattgcggacaattaatttagcatctcctcccgagttgacgtgggaagagccggggccatggcagacttcgcagcctgaattagctagctctggagtcttttcaatcgaaacaaaccccccaggcctcccgtatcctgtagtatggcagccgtagcactcgacaagctctagaggggtaagtttatctgccaatattttaatacttttgtatgaacttgctttttttgcataactattgtaagatttaaattgatcggaatgacattcgccacaagccttagaaccaacaaaaatagcctcctctgcgaggactatccctggaaaaaatagggataacgcagccaatgcacttagaataacattctgcattgatctctcctccgttatcgaaccatgattatgacttaggattgtccatcaaagatcatcaaacatacacaacaatatgaaaacgatatcatttaaagaagctaattattgaaaacaaaaacgccatgatccaatgactagctaaccagtcgaggagtcatggcggctcggctgcctcaaccgtgaggcccgtggctttccgtacgcacccgcctcacgacggggttggctttacagacttgtttcaacgcttgcatatcacctttgacaaactttttccaccaaatacacacagaactggcactgaaaacctctcaagccactgggtgctcacaaggcgaagccactccgtgatcatcgtggagccacccaggggcactcatccggaccaatgcgctaggcatgtccaaaatcgaaacggagacagcaatgccgctctatgccatacccggacagaatccgcttgaaattcggcacctggtgcttgattacaacggcaccctggctgcggacgggacgcttgtgaccagagtgccgaacgattgagtgaaattgccgtcccaccgcacaatctgttaatccacgtggtcaccgccgacaccatgggcacggtcaagcgccagctccatgatttaccctgcgagctttccatccttggcccggacaggcaggataaggccaagcttgacttcattcagggcctcggggttgagtaagcggttgccatcggtaacggtcaaaatggccacctgatgatggccgcagccgccttgggcattgcggtcattggggaggaaggggcggcaactcagacgatcttgacgtcccgtgtggtgtgccgtgacattatctccgccttggatctgctgctcaaacccaaacgactcgccgccaccttgcgatgttgatggccgactgggacatgccgccacatcttgagagcagttacccccagcccgaggacgtcgaaaatggtaaatgacgcatggagcgagaacagaacagggaccagattcactgccgaatcggagccgtccatgggtggcaaccattttcgctgccctcttcgcccccggggaacgctgctgagtgatccacaacctggagccaagctacacccacccagataatttttgttcagttcttcagaacaataggacaatttcgatgcaaaccatgcctgccatgaccgctttacttgctgctcacgcttttcatgatgatacaataccgacttttgaacgggttacagctactcagatcccatcatcttggaccaaacttctttgcggaacatcaagcatgaccatagcattatcaaaatgttacggcgaagaagttgctctcaccctactcggtgacgatatactagtccctgaaaaaattttagaccgcgctgtcgttttatctggtaggcagactaaaaaaccatttgcactcgctggcctccgcattcatttagaacgcttcgcgccacatgttcgagttcgttttgtagaagcagtcatccctttcggaaaaatactacaagaggaaggaatatcattcacctcggagcctgcatgtttctttcagacatcatccaacgctctactctctcgagaactaaaaatttctgaaggaataacgctgttcggtcgaatgaacgacatcaaaagcaacgaacgcattcaaattgccgaagttgttgaaatcttagtagagcctcaatgctttgagtagatgcggcccccatagtgaaaacgtggaccaagttcgaagccgagccgggtcccggccaagcacaactggcccttgacgtccgatccttcccaacgacggtcgatgaacaggtggtggttagttggttcgtccaaaagaccttagatagcccgtaatgcacacaggagatcgtcaacttctctacgtaaaactgcaatcgcttctgcagcaccttgaatagaaccactccgaccaacagcatcaagtttaattgcagcctgaaacgcttggccagtatcgaaatttccgatttcactcttgaatccgtgtgcattttcgtgaatagcttgcggagaattcgcaactaacgcatcctgaaaatttaaaaatcgcgtttctgcaattttagcaaaactttctactaagtccgtaaaaaattcacggtcattgtcgaagcgagccaacacactttctgaattgatagacaaattaaaacatgaaaattcattactcgtttcttcttgtttgttgcggatgggcgaagcccatttcgcaagtttctctgcaagcataccgggatcaagcggcttagagaggtaatcattcatacccgcatcaagacatcgctctcgatccgactgcatggcatgggctgttagcgcaattattggtacggggttctcgcaatgagcatcaagttcgcgaatgcgacgggtagcctcaatgccatccatgacgggcatctgaacgtccatgagaatagcatcaaatttacgtctctcccaaagtgtcactgcgtcttgaccattttcgactatggtaaacgagtgccccattttgtggagcacatggctgatgaccctctggtttacgggcgaatcttctgccaccatgatatcaaggccctcgccaagcggcactgtttctatactagactccacttgaaattgtgtcatcttaacggcatgaccgagagagattagcacgcaatctaggacgtgagatggatcgaacggcttaagcaggaaatccttcacaatcgagggggcgattcccccttcgagttcgatttggctggacgatataaggataaaagcgggaggatgactgccgcaaagtttctcgactcgttgagccaaggccaatccgtctatccccggcatttgcagatcacttagcaaaagacggatagggtttccttgggcttcgtgttctttgagtatggttaaggcctcaaatccatccttagcctcttcaactaaagctttccatcctgcgagcagctcgcgaagaatcgcacgatttgttgcgtggtcgtctactaccagcacgtttaaaccgtcgagtacactgctgtcaggaacccagtaggctcttggagcttgctcagccacggccaaaccaatctcgaaaaaaaactcactgcccttgcccagaatgctctccacggacagctgtccgcccataagttcaatcaaatgtgacgagatcgctaggccaaggccagtcccgccaaatcgacgagtaagtgaactatcaacttgttcgaatggtttgaaaataatttcctgttgctgaggagacatgccgatacctgtgtctttgacgctaaaacgtatatatgccactccatcgctttccgataaaaaatcaacacaaaccgcaacttcaccacgttctgtaaacttgatggcgttgccaaccaagttgttaataacctgctgtaggcgcgcagggtctcctcgtaagaacactggcatgtgaggcgaaacaaccagaatcaactcaacgcccttctgctggcaggcaattgtcaagggccttaatgtcatgtttagaactcggcgcaaatcgaactcaataatttctaaagagaacttaccagcatcaatcttagaaaagtcaagaatatcgttaatgacggccatgagagtgtttgccgagtaatggaccgtcctaacaaactcaagctgcttgtcactcagtcgtgtgcccagcaaaagattacacattcctataattccattcattggagtgcgaatctcgtggctggtattggctaggaaggcacttttcgcgcgactgccagattcagcggcttccttagccttctgcaagacgtcattcattcgcgactgttcatcaagcctgccagccagtttcatgcgatccgagttggcccgcatcaattgccatagcccagcaagcagggccaacgaaaagcctcccgccacaaaggtcatcatccacggcgagacgcttcccagcacatcagaggttctggccacgctcacaaggcccaacggaaaatcacccacggtggcccacattgctaggcaagacttcgctttcaacttcttcgcaatatcgttgttgagcgtgacttgtttaaagctgggctgggctagaattgctagaacggctgctagttgcccgggggcaaaatctcctcctagggatgcaactgaagcccgcttccacaccacccctaaagtgatgcggccaggtcgcgcaaaaggtttgaacaaatgtgataaaagatttttcaaagggatgcgggccaaaatatgaccgtgtggctgatctttaaccactacattttgtaataaaattacacttcccgggtaagccgacgtatccactatcagtttggtatctgcatcactggagacaaatttcttccagtaatcttggttaggttgtgttgccccctcggcaagatgctgggcactcgctatctgttcgccttcgttgtcgacaagtgccacggcatcataaatctgttctcctccaagggagcgatcgttaataatcttttcgaagagttctgaaattgctagacggctggcaagcaacccgtactctaccgacatccccagtgccttgttctcgaaatatgtgagcacttgcctactgtcggctatgtcaagaatatcattgttacgttcataaaaaaaataatcaagcgtagacgacatgttgagtgtagcgttttcaaaatcatcaagagcagatttctctctttttgagagagatgaataattaaatgctattaacgctccgaatacgagtacaagtagaagtgctccaccccaaacaagactactactttgcccccctccagagggaacttctctggaggagggtggagcagtgctgccgtggaattgagagtttttctgatctgacatggtcattccaaatgttgctactttttgaagaactccgggaagtaagtaaagacgagaggataatacttgtacacaagagcttcatattttcctgaagctttgaactgcgcatagaacttattaaattcatcgcggagaagtggttgatccttgcggaaacctacggccatttcctgctttcccgtcaatgggccaataatcttgattttcccggggtacttttgaagggcaattatggcgtcagggacgtcgagaagtgtggctggggcgtctcccacgatcacagccggagcgaggtcgttgagggaaccagcaaaatccttagccgtaacgcctgtgggagttaagttaaaaagcgatggatctaggcatgtcccactcttgcaaagaatggtcaagtccttcagtttggcccttgtgagttcgatatccttgttaatgtcaccagttggagtgatcggtgtaaggggagagtcggcacgcaccaccaaccatacctgggtgggaaacgttggacttgagtagttgagaatcttctcccgccacgaaagaactgtaagaccattagccaacagatcacccttgacgggcgcgtctgcgatgaagttgacatcaccgtcctgcaacttaaattttttgccgataagacttggcagggctgtgggccagtcctcctggacaaactcgtatttaaccccaagatgctcacagaaggctttgataatctcgacgtcaaaaccgtcgccttgaccagtgatgaagtttgcgtacgggattcccaggtggcgcagaactccgctggtttttatctctgggaggtcattcgcccaggagtaggtcgaaggagcaaccaaaccgatcgcaacggctaggattaacgcacaaaagaaagttgccctcatgagtttttccttctagggtttgggttgggtgcttcactattggttttctgcttgaatacgaaagatatcaggcagaagtgaaaaaaataaatccaagatatttgggtcgaaatgtcgctcccggccttccagcataatgtctaagacttgttcgcgagacaaggctgggcgatagatacggtcgttggccagggcatcgaaaacgtccactatgcttacaatccgcgcgcttacaggaatggccgttccaatcaatccgccaggatagccactaccatcccacttctcgtgatgtcgcaaggagatatcatgggccatactgataacctcaaactgcgagccagcaaggatacttgctcctataacagtatgttccttaatgatctcgtattcttcagacgtgagtcggccgggttttttgagaatatcgtctgggattcctgccttgccgatgtcatgcattgatgctgcgactcgaagatcatcaaggctggtggagtcccatcctaaatgatttcctaacagggcactcgtcaacccaatgcgacgtacatgagagccagtttcctggtcgcgaaattccagggcagaaagtagacgttcaataagttcgtctttggtcttccttaggagttgcgtttggcgctgaacaacaccttctagggacctgctatattcctgatgctctcgttcgaatcggacaattcgttcaccaacatttattcttacttgaagttcttcaaaagaaaaaggcttgacaatgtagtcgtccacgcctccgtcagtaaagccgtctactagatcctcagtctctgatttgcttgtcaacaatattatgtatgtataattattgtttttggcttgacgcaccctctttgctagctcaatgccatcaagatttggcatcatccagtcagtaatcagcaattctggagggtcttcgtatgagaaaaatttatcaattgcagaaagtccatcgcaacacgtttcaactgtatgcccattcttttgtaaatacctgcacaaccttgctcgcattatggggtcatcatcggcggttagtatgcgcatgagttttcctgtgtattgcttttaaacaacttaacttatttcttgtaacaacattgacaaaaaacaacgtgtctaaaattatttagggatcaacgctgatagttcgtctctcctagggtatttcttagccagagcagttccgtctgaaaagtacaaattcaaataggattgaccttcatgctttcaactcgcactgttttccgagaatcatcgaaatcttgctaaatgattgcctgttttttattcatgttttgctaaatcgaaataaatctaactaaatacggttgatgttttgtgtgtaaactcaaaattagccagagaaaccgtcgatgagccaaagactttgttaacggatattgttgatgtgcaggcgcgttttaaaatattttggcgattattttgttgatagtatgtaaatcgacaaaaacaagacgctagagaaagatttggaataaagctataatcagcagcttgccgagcaaaataacttgctagcaaaaatcgtagttcagcacatactacttatgaactgcgtcttttcaaggaattcaacggccatctgtctggataatccgtctcctgttttgcattgattgacgttacagtttgattccttccatgtcttttcgctttatataaaaaattatctgctgattttaacaaacagtctattgcttttgtatgttttgagcaagctgcaacgccactgctaattgtaatattgattggaatttcgtcgtattcaaagatagttgattcaacaattgttctaaatctttcaactgctgctgctgcattttcaagagatgtttcaggcattgatatggcaaactcttcgccgcctaagcgtccaattatatctgaagatcggaattctgctgttgctaatgtgcaaattttttttaaaaccatatcccctgcagaatgtccccatgtatcatttaccatcttaaaattatcaatgtcaaaaattgctacagaaaattcagtattatagcgagttgctgaagataataacgctccagaaatctccataaaatggtgtctattgctgacacccgtcaagccatcctttgttgcaagcattaaaagatttaattctaagtttttttgttcagatatatcagtaatcataatgaaagcacctccagaagaattatctaatcgagatattggagagcttgaaaacaaaacccaaaaacattcgccatctttatttctaatcctacactctagtttgggtatggaccgttcagttgcattgataattgttcttgaaaaagattcttcgccacaagacaaaaaaatgctatcaatatgtaactcgtgaagctctttttcgctatagcctgctaacttctggattattttatttgaataagtaatttcaaaatactgattaacagcaacgatgccctggtttgatgtttcgactatgagtcgaaacttttcttcactttcttttagttcattttctgcgcgctttctgtcagtaatgtctgaaacgaaaccttcgtagctgttgatattcccgaatttatctctcactgagcgcataaacaaagatacccatgcgatagttccgtctttcctttttcttcgctgctcaagcccatacaggcaacagtttttaagttgatctgtcgtttgcgttctttcagattcattgacataaatatcggattcaatagaactaacgcggtttattaagtcctctgcggaatcatatccgtatattcttgccaagctcggatttgcagcaagatattttccatttggtgttgactcaaaaatgcctatgggagaattttcgatcaaatttttgtatttatttttaagtttttggagactagtttcaatttgctttctttctgtaatgtcaaccattactgacaagtagaacttctggccttgggactctattatttctccgtaaaaaattccttcatgaacattgccgtccttgtcatatatttgcgcttcgctgtttttaatttgtccgtcttttgaaagtatttttaataagtcacaatacttgtcatggcttgtgaataaatttaattcatcagaggtctttccaataacttcgtctctttgatatctagttatctcgacaaatgcattgtttacatctatcagtttcatgctaggcataattgacaaagccataggcgctggattgctattgaataaacgctcgaatctttgcaaagcttcttgttctagtgttaagtcgcgtgatattccaaaaatacaatcttgacctttccacctgcctttccatattcttgtttctgcgggcagtgcggaaccatcttttttcaacaaggaaagagggcaagtttctcttttcccctttagcatgtcagcaaagatagtcactgcttcatgcctgacgttttctggatgaatatcgatgacgttcatgtttagtatgtcttgcagcgaaaatcctaaaatttcttgtacagagtggtttacctgaactattttgccgtcattactaacaacccaggctatgtcattgattgattcaaaaaagcttctaaaactgtcctcgctctctccaagagcaatttctgcctttttttgatccgttacgtcaaatagcacccaaacgactcctcgccctatgtccattgcatcaagagcactgcccgaaatcttaacccaaacaacttctccacattttctttttaatggccactctgttgaaacgatacgttgttttgctgtggcactccagtaacgctctccaaattttaaaaacgaatcactatttacatgcaacatttcaacggagttcccaattaggtcattcttgtcatatcctagcatttcgagtaggccagagtttacatcagttatgacgcgatgctttgtaacaacaagaattccgaatgcaggaacgttaaagataccatttttccaagaaatgctgttaattatatgacactgcgctcccaaaaaatttatctcagcgtcactaaaagaagcgcgtttagattcaagttcgactactcgtcttcgtgcgacactcaactcttcttctatctcggaatacgttaaattcacatcttgcatgctggagcctattagtgcgtattggttttggtgttgagacaataatataaaggtcgcagccaacagctttcctgatttgtctaacaatgcaaaaaaaatgagataaagcagtagatgcaatcaaagtactttaaaaaacacgcatgcaatagactttatccatctaaaatcatgtcctcactttcattcaacggcaaataacccgaagtaagtaaacatcaatgccacttactaggacaaataatcaaatcatgggtaggcatctttcaaaaatatgaactatactgtacatcgcatcagttgtcaaacagcaccgaaaattgacccccaatcagcgtccaattttgaccccctcgaattgagcgccatggcttctcctcgtggttggggggggggggggggggggagcttattggcttctgtgtttgagcctccagatgtcgttgccggtctcgatgatctcgcaatgatgggtcacccgatccaagagcgccgtggtcatcttggcgttgccaaagacttggccccactcgccaaaggtcaggttggtcgtcaccaggaccgacaaggaaacagctattccgactacgaaccagatgagccaaggagggaagcttgtcaccatggagcttccttattgagcagcttgacggaacaatccttgaaaggaatctaacttactaattttccagtcaattgccctcaaatacactgggaacacatggatggtttcggaccacacttcccggcgtcatccattaaagcccaaccctcaccttaggctggccaggcagaagacagcgcactgccgacagtcggtctttcccaccctggctcggttggccatggccgaccttaccattatttctccctggaccgagtcatcagggttccggtaaaatcatttcactggaaaggtaccgaaaatggttccgacggtccaaccccttgtcgctgtgagcaaaaacttctcgtacgaaagcagccccgccgacccttccgagtgacggggctaactagttcgcaacaaactgataataatggatttctgcgaaacacttttcagaggacaagacggatcaagaatctacacgccgaacgatttgaagcataccatccgcatcacaggtgacccagaaatcatcatcttcttcaacgggcgaagggttcaacccgcaaatctcatagtatttcttgtccagtttcattagtttattcaaatacacacgcaaaatctccattgaaacattgagcgcttggactatctcttcagcacaatgaccacttcgtataagcttacgcaaaacatgagcatcaaaatttgactcttctttcataccaactccatttagttgagtttatcactatggctcagcagctggccacttttatcctgttgaatgtttaacaccagcataatcaaaaaaagcggcatcagagagtgcatctgtcaatctcgcatcaagatcaaaagctagcgaatagcttccgcgatcaatattgcatcaaaagcatcagagacaagctggccaaatcttatgcctatcttgacacacaccaagggcttttccattggactttcataccacacaacttcaatgtgacgctacttatttctggcagatgcgcaagcattttctatctaattggcaggactaagccagtccgagtccgcctccaggccacttcaataactcagagacctgcactttttaccaactggacaggagatgtaccaggagaacccttggaatcggatcagaaaggagaaaagatattcaatttggcctactactgcctcttggacaaaattgatccttgctgggacattttcggttctccagaatttatccaaaattccggttattcagagctggacgttcaacccatcttctacgctatagaccccaaattaatgaagtcatttggacatcacgcagttatacttgaaaaataatctgccaatacgtatttgccatttcctccctataccgtttaattaattttcgctagacaacgcactttcaaaaacttctccattgcctcctttttaaagacatgctatttacagcaaaacatacttacacttgagcattttttttggcacactatcagttttcccatcatcttggaatttgcagacaaatcgtcaacaaaacgaggacgctatgttcagagacatgaaaatccgtacaaagttaactttgatacttgttttgttaggcgtcgggctggctactttatttctgatttcccgattgacattaacaaaagtagcaattggcagcaatgcatacaacgatatactcttaagtaaagatctcaatgcagacatattaccaccgcccctttatataatcgagagctacaattccatgcttaaggcgacattcattagcaacgacaacattgaagaaattctaaaagcaatcgaaaaggacaagaaatcgtttgaagagtctagatctatttggacgaaaaaattacacgcaggagagataaaaaacgaattactcgacaaggtttgcgcaagcgctgaaaaaatatttgacgtatttaccaacaatgtcacccctgctatacaagtcggagatctaatcagggcaaaacaaatcttcaatgaggcaataaaccctgaattttcaagacatcgtaattcagtagtaaaccttgcatctcttcttgaagactttagcaaacaagttgaatcccagggcgtcacagaggtaaactctggaagtttattcttggcaataggatttttcgttattgctattgtagtaatagccttatttttcctcttcgctcgatttctcatgcaccaacttggtgatgatccctcctcactggcagcaatcaccatgcaaatcgctgacggtgacttgaccgctcgattcgacaaaacacgacctgagataggtgtgttcgggtcggtcaaacgcatgacggagaccctcaagaacaggctaggtttcgctcagggcgttatgaatggcattgcaacgccatgtatcgttgtcgatccaaaagcaaaaatcttgttcatgaaccaacagattattgattatatcgaacgcggagggaaacccgaagactatcttgggttttcagccgctaagttcttttacaatgatgaatcgaaacaaactatgagcgaaaaggccattgcgcagaagtctgctgtcgcgaccaaggatgtttcattcatgtcattcaaaaacaacccaaggttctgcaactttgactcgtcaccgatcaccgatttagacggcaatatcattgcaggaatcacactcataacggatttgacggaagtcgttgagcagcagcgcgctgctaaagatgctatcgctcgtggcactctacaggccgcaaaaaaacttgaatctattgtggagatcgtgacttcagcttctgaacaactctctgctcagatagaacaatcaagtagaggttccgaagaacaagcgcgtagcatttcagaaactgccacagccatggtagaaatgaacgcaacagtacttgaagtcgctaaaaacgctacgaacgctgccggaacagctgatcaggcaaaaaccaaagctgaagaaggagcacgggcggtaagccaagttgtaaagggtattggtcaagtccaaaatcaatcccaagaaatgaaaattgacatggacaatctgggcaagcaagctgagggaatcggacaaattctaaacgttatctccgacattgccgaccagaccaacctcctagccctgaatgccgcaattgaagcagcccgggccggtgacgccggacgaggattcgcagttgttgctgacgaggtcaggaaactggccgaaaagactatgaccgccactaaggaagtcggtaacgcgatccggggcatccaggacggcaccaaaaagaacatcgaaaacgttgagcgtactggaaaatacattgaagaggttaccaacctcgccactaattctggcgaagctttaaaccaaatcgtcactttagcagataagaccactgaccaggttcgttcaattgcgacagcttctgaacagcaatctgctacaagtgaggaaattaatcgcagtattgaagcagtgaaccggatttcctccgaaagtgctgatgcgatgcgcaaatcggctcaggcagtaactgaactggcaaatcaagcacaagttcttaagcgccttatcgaggagatgaaatctgacagtggatctggcactaaaaaacttcctgcaggaaagaagccacttgcattagaaaaagggtaatgagaaacaatcttcaaacatgccaacctactctttcgcaccgttagtttcaactgcaaggaaggttttatcctagcgacaaaggggtgagctttcattatgttcaatcaacacatattgagttcaccccgcaacccgaataaatatatgccattccgagacattagacacatatcaacaaacattcttggcgaaatatctacaacaacttatgacaagaaagttttacttatcatgtactattccgaattactagctcttaacttcgtagaaatcgaagaattattcaaaacgcatggaagaatcaagctgcatagaatattttatctagatgtaaactttgttgaatatgtctactctctttttttgaattcaggaattgacaccattatgaaacaactttttgaaaggcttaccaagatacaagaattactccaccagagaaaacatcttaaatcttgcgaaacctcaaagattatccaataagcctcgtcaaaacaaagcaagacgaaaaataattcgcacttggcaaaagatgcagcattcttcctattatacgctacgaagccgcgctaccccactccaggacccgggacaaggcagtttctaaggttttagcggcaactcgggacttaaaattcgcgaatgttatccaaaatccccagattatccagcccggttctccagtctttttagcacaaaatcgttggggattggacggtaaaaagttaaactgggggcaaccattgtcaccggtaacgcacatggttgcatcgcgtccgaatcaaaataccgacgataagtaacttttcaaattgatcttcttgttggcgatgccgagcttcttgcgaatgttatcacggtaggtttcgaccgttcgcggagaaaggtccaaggcttcagcgatctccttcgtcgaattgcccctgcgaattctggccgcgattgacctttcgcgctgagttaggcgcgcatcacccaaaacaggctcggccgctaacgcttctgcctcgctgccgctgagtactctcagtagtgcatcggcggctttgaccccaagcacgtctcgtcggtattttgtcaatccgtctcttagggctttgcagagcacttgcgtggggcatggtttggttaaaaaacggaagacctcactttggttaacggccgcgatggcggactccagatcgccatggcccgtcagtatgattcgtacgcagtcgggggccagctttcggagatgctccaggaattcaacgccgttcatgcctggcattttgtagtcggaaacaaccacggcaaatggcccgtttcgtcccatagatttcagcccctccgcacctccttgtgcggtgtagaggtcaaattcccggcgcagcgctgtctttagagcgtccaggacattccgttcatcatcaacgaggaggattttttccgtcatgcaacgattactcccggttaaaccccgaacgcacagccgaacagggaagcccgcgtaatgacctgccggccttcctcggaccagtcaattcttgagggtggctcctgggtttgagttgttgccgaccatctgcgcaaaggccatcggcgggcgacttcagccccagccggcggcttgccaacagccccaccatgttatatataatcctttatattcaataagatgctgcccgtttcttgcgcctcgaacgacgttatcaaggattgccgatgcccgtcgcctcaaaaactcactctcgcccgactcgaacgtctgctgtttaccgccgaggactataacctcaacatccggcgctatgtagacaactcgccaccgcccgagccctacgacgtgcgggcgcacctgcacggcggcgtgccccggaccgagggcgcggcgcttgccccttactttgccaattatcccggcctgtccgaactgttgtttgtcgcccgcgacgacaactacctcgatttcgccccggccatcaccgaaaacggcggccgcgacggcatcaagacgcgcatcgaggccgcgcccggggtggtgagcaaacatgccgctttccatgccgccctggacggctggtggcaggccgccctgccgcagatcgaggccttgccagaaaaaatgaacctcttcgcgctgtgccgcgccctgctcgataccatcgccgccgcgctcgtgccccagggcatcctgacgctgcagcaggtacatgggcctttgccaattacatgaccaaatgttctcttgatagactgtccaattttccgcaacactttcaggggcacactgcaagaggcggtggtttaactattggaattactttgccgcatcgacaagcttgatgatggcttccgtgatatcaatcttcagatcaatgaaggcgaagccgtttttgtcctgtacggaaagcaggcggtgctccttggcgtaatcggtcaacaccttgttgatcctgtccacgatgggcttgaacgtgccggcttcctcctcgccgatgtccttgcgcagcgcctgcgcgtccgccatatactgtcgcgcgagcttatccagttccgcctgcttgccgctccttggatcgttgagcgccgtatcggttttgagcttctctatggcctcttcctgctttttcaacgcatcctggcgggcggcgaacttggctcgcaccttttcagcggcctgcatgccggcattgcacttggtgatcacttcccgagtattgatcaccgccatggtcggtttgttttccaacatctggcagcccgagcacaccagtagagcgccaagcaccagcaggaatcggaatcgaagcggcatgacaactcctcttgcaatttgtaggcatgcccccggccctacgccggcgggggttaaaacgtgtatctgagcccgatgctggcggcctgggacccgtagcccggccgtagcagttccatgccggcccgggccgtggccgagagtttcgacgacacgcgcatgctcactccgacgtcgaccagcgccgagtgatacgcgtgattggcgcttttcacctgataggcggcccccggggagccaatgaacgaggccacgatgttttgggattcgcctagccactgggtactccaccccacgcgcacttccggcgtcacatccccggccggcgtctcgaaggtccgggccacacgcgcgccgagcaccgtgttgagggcctgggtgtcgcgggcccgaatgctttggccaagggtgcccgcgccggtttcctggaaggcgttttcgtgcagccactgccaggacgccgccgccaacgggccgaaggtgtagtccccggccatgaagtcgtagccgccgccagtggacacgttcacgttccaaccctcccagttccctttagtcgtgtacgatccgctcggcaacggcagggagcgcgaggaccgaaaggtgttgtaggcgccgcgcacaccggcatcggcgtgccaggggccgcttcgataggcggccaagaaaccgagactccagtcgctgatcgtgccctggccgccgccttcgctgtggatgttgatggactgggtgacgaagccgggagccagggccagggtcagttccgaaaacgggcggtaggtcacgccgccggtgatgccgcaagaaacggcggcgtacccggtctggcttgaggagccttgctgcaaggcccgcataccgatgggcctgacgaagacgccaaaacgccccaaggacagggaggatgcgccgccgctggtcgtatcaagcccaagcccatactgattgttttgcgaagccagggaggccgggccgatttccagagggctggcgaagccctggcccgcgccctcctctccttcgtgcagtccggcgtgctgcgccgaggtcaacagccggccggctgcgaaaacattctgggaaaacacgtcgtagacttcggcgctcaggacattgagcgcatagttggtcaaagcgttggccggcgagtaaccggtggttgtgccgtaagagtagtccaggtttttaatgagtgaggccatttcgcccgtggcgttgtaggccacggcgtcgaggcctgcgcccaccgaggaggcctgggaactcgtgctcgatgtggcatacgattggcgcacaagggtgatggtgacggcgttggccgaatacaccggcacgaagatccagttttccggcgtggctccataggtcacggtggaataggttccggaaatgctgccagtttgcgtggtgagcacggtccagactgtcccggagttgtaatacgtgtattccggctggatggagatcgtgccgcttaatgttgcgttgccggtgacggcgatcagatcgttggcggtgggcgtcacctggcagacgtagacgccggtcacgctttggacgaagtcgccggtgacggtgagggccccgggggaattgcccggcgagatgacgccgctgacgctcaggttgcccaccgtgccgacgccgttgagggtggccccgctggcgatggacagcgtgccgccgaggctttctcccgaaacgaggtgcagggttccgctgctgacggacagtgcgccgctgtaggcggagccgtcaaaggtcgcgcccaggttggtcgttcctgacccggccaaggtgagatcaccggaaccggacaggctactggccagggtgagggcgttgccggtgttgtccaggacgccgcccccggcattgacggcaatggactgggcgatggtcatgtcggccgtggtcgccagggtcccgccgttaaaggccaggctggccgtggacgcgccgaggttgttgtcgttggatacggacagggtgccgccggcgagggtcaagtcgccggtgaagccgctgttgtcgccggaaagggtcagggcgtagacgccggttttggtgacttggccgctgccggtgatgctgccggcgtaggtcactgtttttgacggggcgaagttcagggtcgcgcttgaggcaacagctatcgaggaggagctgcaggagccgccaaggctcagggttccggcctggatggaggtcgcgcccgtataggcggcgtcgccggacagggtcagggtgccgacgccggtcttggtcaggccgccggagcctgagaccgtgccattgagggtcaggtcgtggccgttggtgtcgaaggagccgccgccggcattgagggtgacgtcgcggctggagacgatatcagccccgatttgcagggtgccgccgttgcaggtcaggccgccggaggcgtcgcccaggttggcgtccgccacgatgttgaccgtgccgccgttgatgttggtcccgccggtgtaggtgttgttgccggtgaggtagagcgtgccggaaccggttttggtcaaggaaccggcggttcctgacacggcatcggtgatgacgccggaaagggtcagggtatcgccgctgttggcgacttcaaaggtgccgccgccggaacccagggcgatcgatttgttcagtgtcagtgtacccgtggcctggagtgtcccgccggcgagggtgacgccgcttgtgccttgcagattgtctaccgagctgatgcttaaggtgccgccggtaatggcggtggcgccggtgtaggtgttggccccggacagggtcagcgtgcctgtgccggatttggtcagcgcgccgtccccggagatgacgccggagaatgtcgtgtcggcagtgggcgaccagacgagcgtggcgcccgaggcgatggtggcccccgaagcggtgacgcaaccttccagggtcagggcgccactgctgacgagcaaggtgcccgtgcccaagtccacgtcaccgctgatggtccaggaaccggcatcctgtttgaccagggactggaagttgcgcaccgcgccatccaagctgacgctgccaaccagggtcagggtgttggaaccgccgccgccgtcgatgatgccgcgtaccgtggccccagggccaagggtcacggtgtcgtcacccgcgccgagttggatggccacgtcggtggcgctggcggccaggatgctgccggtgcttatgatgatgcagtcggcgtcgctgaaggtcagggagctggccaggttgatggtcccggagttggtgaggctggtcaggctggtcaggctgccagaaaaatcgagcgtcgcgccggaggccacggttatggaactggtggcaagggagcccgtaacggccagggtcccggcgttgaccgtggtcgcgccagtgtaggcattggccccggaaagggtcaatgtgccgtaaccggattttgtcagggcgcccgtgccggtgatcgtgcccgcgagggtcaggttgctgccattggtgtagaaggttcccccggaggaaccgatggtgacgttattggtgaggctgcttatgtcggccgttgtcaggagcaggccgccattgagggtcagggcccccatgcccaggttggaggcggaaccgatggagagcgttccggcgctcacggtcatggctccgctgtaggcgctgttgtcgccggaaaggatcagggtgcccgaaccggatttggtcaggtttccgcttccgctgagagagttggagagagtcagttcgatgccggctccggtggagacggcgctgttggctgtcaggacgacggcgttggccaggccgagggaggtcgtcgcttgcagggtgccgccgccaagcgtcacgacgccggtccccagggcgttccctgtggcgacggccagggtcccggcggatatggtcgtgccgccgctgtaggcgctggagccggacagggtcagtgtacccgagccggttttcaccagacgcccgctgccggagatgacgcccatataggttgaatcagacgcccccgtgttgatcgtcaggactgtggcggcgttcgaacccagagtgacaaggccggaaccggcgagtccgccgatggtctggctgtagccgccgagggccagggtgccttccgtgtccacggtcacggccgagttcgaggaaaacgtgttggtcgctccggcttgcaacgtcccccgggtgacgacggtggcgccggagtaggtattgcttccggacaggatcagggttttgatgccggtcttggccaggccccccgaaccggaaatgatcccggaaaaggtggcgttcgcccaatagtcgttgatcgtgagcacggtggcggcatccgtgcccagggtgacgctgccggcaccggccagggagcgcaggagctgactgtagccgttcaggtcgagggtggcccccgaggccactgtcacagacgaattcgcggaaaacgtgtcgccggctccggcttgcagggttccggcgctgaccgtggtcgctccggaatacgtattcgcgccggacagggtcagggcgtaatccccggtcttggtcagcgaccccgagcctgagatgatgccggcgtaggccttgtttccggtgagcttccaggtcagggccccgtcgagcgtgatgtcgccggctatggtcacgatggaatccatggtcaaggaggcgttggacgagacggtcaggctgccgaagctggtgagcatggagtccacggtccaactcgcggcttctccgttgccgccgattaccaggctggtcacgccgtcagtgatgttgctaaaagtgcctcccgtgcccacgaggttgagcgtgccgccgcccaggtgaatccagttgtcgccgaggtcggctgtgttggtcagggtgacgacgttgtccgaaccggccgcgtagatggcgtacccacccaatgggaaggcggaaccatcggtgaccgtgatggagccgctcacgtagagattcaccgagcccgtggcgtagagagcgtacccgttggcggtattgtcggcctcggccgtgacgcttccggaaatgctcagcggcgtggaggcgtcgccgccgttgatgtttccgctgtcgtagatgccgtaggcttttccggaagtggccgtggatgtaatcgagccggacaccccgcccgcgatcgatatgttggcgccggccaggccataggcgttcccggagccgttggccgtggccttgaccgtgtctgacaccccgcccgtgatggcgatcccggcgcctttgagtccgtaggcgtcgccgatgccctcggccgtggccgcgacttggccggacagtccgcccgagatggagatcgctccggaagcattcaggccgtaggcgctcccggaactcccggtcaggcccgtggccgtgatcgtgcttgagagaccctccgtgagagtgatgccgccggaggcggcatacaggccgtagacgctgttgctgccctcgcctttggcggtgatgtctccggacaacccgccggcgatggcgatgccgtcggaggcatgcaggccgtaggcgcgtccgttgcctccccccgtggcggcgatgttgccggacaccccccccgtgatggagattacccccccggcggacaggccgtaggcgtccccctggacgccgactgtggacgtgatgttggcagacaacccgcccgtgatggaaatgccgttggcggcgcgcaggccgtaggcgagcccggtacccgtaaccgcggtcgtgatggttccggcgaggccgctggccacaaggatgtccccagcggcatagagaccggttgcctcgccataagcgggtgcggtcgctgttgccgtcaaggtgacgttggagccgatagcgccaatgttcaaggtggagcttggagcggaaatgtctgtgacgaaacttttgccgctggcctcgatgacgatggcggcgtcgcccgtcaggctgaactgggctgcggaagaagaaacggaaaatacgggctgggacgaattgccattgtcgtaggcgatcgtcacttcgtgcacatcggcgtcgttggggttcagagtggctggcgttgtgatggagaggctgccgttcgtcagcgtgagcttgggcgaatacgtgatcgtatgcagaaaatggatgatgttgctgaatggatcagtggccttcgtaagggcgttacgcagcgtcgtcgccgtggaggcgtcgtcggtatacttgtcgactgtctgttccgttgcgcccctggccgggccgacggccaacagcacgaacaaggctgcccaaagcatcgccagccagccaaagccaccgcgctgtatggttgccctcccccggggagcacgcccgttgcgacctgatacgacatgtctcaccgcgagacggataacgcgaaaaagacagtcgtggctgtcaaggattcccttgttttttgtgtaacgaaattcggggacagggcagctccgtccggccagaacggacgggggagcccggccagggcatggccaattctatcttggggtaaatgtgtaacgctcccgagaccggtcaaccgcgccgacgaatggcgaacttgcgcagctccttcatgctggacaggcccagtttgcgcagtagccgcccgtaataggtctctacggtgtggaagctgatgttgagcgtctggctcatttcgacgctcgtctcgccgcgcccgagaccgaggaggatctgctcctcccgctggctgagggcggcctccccatcatgcttcgatcccagcacccggtcggccaacgcgcgcatgacctcgggactggtgtagcgccgaccggcagcgaccgccgcgatggccgtcaggagcacgtcctcgacctctcgcttggtgacgtagcccatggctccccgaccaaaggcccgctcgatggactggctgtcctcgtgcatggaatatatcagcgccggcacgccccgggccgtgagatcatcgagcaggtccagcccggattcctcggccagggacagatccaccagggccacgtcggcccgggaaccttcgatggcggccaaaagttccgcccggctgccggccaccccgcacacggcatgcccgctttgcgtaagcagcagcgacaagccgttgcgcaggaccggatggtcgtcgaccagaaagacgcgcacgccggatggagcaacattatccatcggttccctcccgtgtcgtccgctccgccgcgcaggccagggaacaggtcaccacggtcccgccgccctcggcgtcgtctatggacagtgtcgccccgatcatgctcgcccgataggtcatgatgcgaagccccagtcctcccgcgcttcggaccgcctggcggccgacgccgtcgtcgcgcacggtgagggtcagccgccgatccgactcgcaacccagggtgacgatgatccggcctggcctggcatgcttgacggcgttggccaccgcctcctgggcgaggcggtagagttggacgaggtgctcgttgaggcacgattcacagggcaactcttcgaaatattgcattttcactccgctcgactgccccacgcgtcgtaccagatcggccagggaggccccgacttccccaggggcgagctccacaggccaaagacctcgggaaaggtcgtaggcttggctgaccgagtccttgagcagcgagaagatggccgtgacttcctcggccacgccctgctccggtatggcgctgcgggccagggccgcgcagcgcatcctgatgcccaccagctgctggcacagcccatcgtgcagatcgtggctgaggcgccggcgttcctcctcgctgacattgatgatttcccgctccagtcgggtacgctcgtccatctccgtgcgcaagtcggcggacagattttccacggccgtgaacgcgttggcaaagcgttgggccaaggccaaggcctggaacaaaacaaaggcaagaaagccgaacaggaggatgctgccctcggaaaagctgatgatatgtccgtaaatttcgctcaaggtggcggccgaaaaggaaagatatccaagcaaaaggaaaattgctccatcacgaccccgtcgcacgcagacaataagcatgaccagaaaatagcaattaaacagtacggttgatattgcgaaccagtacagcatggtatagatgacaatatttggctgcgtcagcacgattaagacaaatgcaagatttctcaaatcacacagattctgtataaagcgtaaaaattcaaaaggatacaaagatctatagaatctgtatacaatagaagacataattggatagcttattactgaaattttttggataatatctggatctgccttccggatgaacatatttatcaaccaatcagacgggtcagatgtgacataataacaggccaacaaaaggcaacccaagctgaaatagagcgtagatgattcctttcgctttagaaaatagagaaccaaatgatatgcgaccatgatcagcaggctgccaacaaaaaacatgctccaggaccagatacggatatgtatcaggtccagttggtccggcaggccaagcaggactggataaagcagccctccccggcgaaacgcatggttggacacctgcagcaccagatcgatgggcttgccctggctggcaaaccgggccagcactagggagcgatgcggcgtttcggtagctgagctgcgccccagttcgccgctttgggcgacaagcttgccgtcgacccacagcctgtaggcggcgtggatgctgataagccgcagagccagctgatgttccccgggccccggcaacaggcgcaagcgcaaggtggcctgtccctggccgggcaagggctggccgtggagcatctggcctttccacgtgccaggaagattcatgaaaccggacggctggggcggagtaaggtcgggtttgaagtcttcaggggcaaggagccggtcccagtagaattcccactggccgttgagggcaaccgggccgttcccgacgaggtcccaaccggccaggtcgagcaggccgcgttcggccatgggcgctttcttgtcctgactggagcatcccagacaagacagcacgaccaggaagaccaagacagcaagaggtcttgcatgatgtgtcaggaacatgcatccacccgatatcgcacggcgatgcgctattccctacggcagtgccgaaccgttgtcgagcattccggcgacggcgtgggacgacactgtgatcaaggactcatgcctctgtggcgcaagctccgtatcccatctcgtgatcgggagtggcgatatagcgcggcattaaacgaaagtaagcctgaaaaagggccgatacttccgtgtttgccaattgggttgggatccctacgaggcagcacgttgcccacgagacacacctgccaatgggggcccctcccagtccttgtaggggccgtccttttgcaaggcagtccactcgatagccaagcccaattcttcggccttctcctttgtcggctgcccagtttccaggtcccagcctctcaaggaataatagtagtccatttcctcatgaatgaccttttcatcttcttcagtcaggcctcccatgccatcgccgagcggctggtagaaatattctggaaacttgtcctgcgttcgcgttatccccagcctggcatcgatcattctttgcaaattgaagattctttccccaattctttcgatcgactccgttgtaaattcttttccagtcgccgtggacaacatgcgcgcggaaatgccggcccgcgtaatattgttgtcaacgatgcaggctatccgtctgcacaagatgaggctttcgttggcgacaacccaattgcctatcctgacgtttagcttgcaccaccctttgggctcacccttgctgaacattgcatggtcgtcagctccgacaacctccttgactatttcggccgcctcctcccttgtataccctctgccagaacgaagtccttcttttcccgggaattcccagctgaaatcggccagaccaattgactgccacccccaggtctccaagcaagcacccctatagggcgtaaaatggcacatgacagccgggccgatattcctcctgtccgtccgcggatcgtccttaccgtatccggtcgtcccccgcaccgtgttgtcgtactttcgagcttcgggaaacagcctggcaatgttcattttcccttcggcaacaaggttgccaatacgctcccgcttcgccatccagtggatcatctcctcgatgatcttgccatctccggaatcaagttcgagtccgtcggtgtcttttgcggaaaggacgccatctttgtataattgcatgacgatgccaatatcaccaggtccttctttccaatctattccatagtcgttgagcaaatcggaataataattcagcgcttcaaggtcgttgacgcccagagcggaaaagctctcctggtttgcgatctccggccccgttccgcgtgtcggatattttcccctgctctgttcatgatatccacaacaagccatatgacagttccagcatgcttcgagcctgacagcgtaatcataaatgtgttcggccagccttggcttgaaaggtgtcgtatgaaaataggcgagccagagtgcaaagcgcggccaagcgctgttttctttaatggcattgcgaaaatctgcatcgttctccagaaacgctttcgggtcggcaacattgacgccctttttgcctctgacaacgatcgctttcagatttttcgacccaagcacggctcctgtaccacattttccgccagcagacttgaatccatcgatcatggcggtcgcatggcgtaccaggttttcaccggctggccctatgacaacgctgcagacttcaccatgctgctttttcagcgtcgacaccgtttggtgcgcgcccagaccccacagttccgatgcatccttaatgctcacggaatcgtcgtcgatccagagatacacaggctgatcggctttccccgtaatgaccaaagcgtcataccccgcctgcttgagcatcgcatggacgaagccgccgcccgaaccgccgccaagatgtccggtcaccgggctgatgtattgatatatccctcttccgccctgggtggagagcccggtcaacgggcccatggcgatgacgaagatattgtccggactcaacgggtcgaaccccgcccgtatatccttttcaaggatataatcccagataatcttgtcggcgagccccattcctccaagatatttctcaagcaattcctcggacaacggtatactttgtaccgttttttccgacaaatcgactctcagaatacaacggttccaaccacagaccaaggtattagcgttctcttccatactatacggccttctcaagcttgatcaccaaagatggacacttcccgatgcactgtggatcatcatcattatcgtggcacaggtcgcatttcacgatcttatcaagctccttcgaataccaacaggcatgatatgggcatgccttcacacaggcgcggcagcgaatgcaggcatcatggtcaatcaaaacggcaccgagcttgtcgctacgaaaatgggcgtgcttcgggcagacctcatcgcatggcggtatgccaggacaatgccgacatatcgagtggtcaagcatttgttccttttcgcgaagggtccactcgttcgtgtggtggccgattcgtatccctgagaattccgaggaactgcgtccttcatgtgaaagcgcgcacaccaccatgcaggacatgcagcctgtacatttttcggttggcctgacgtgatcgttggtgcaggccgtttctccttccgccacaaccaaccgcatgatgttcttcattttatagactagcaacgcaagtctggcatctttcatgtcttgatcgtttttcttttccatcgcggcccccttcgttacgctggcgtggacgcccgtgccgtcatgcggcggccggatgcgctgttccatcccgtgtcacgtcacatgcgcaggcggcaacagccactagcaggcaacagcgcccgcgcgcaggccggcacgacaaacgctcgtcatcaactggctgtgctagcgacgcccaacggatgccttcctgcataattcgccttcgccgaccttccttctttgtttttcgtaacacggagtcaacgtcgaagtctgtcaaggcttttcctgatacattgtagcgaaattcagggacagacaataaaatgtactcccagcaacagtttgcatgtcataaacacgggccatgacaatcagactctatgttttgaactacaaaaacagagaaactacttcaatatgcattaattacacattgcatatgttagttcaatctgtagcaaacaaggcaacaggagggcaaaactcattgattttagtcttcattttgaagcaaatccttgcagaaccgtttctagtatccatcaactttcactctcacagtgaatccgccaagacattggccgacctgtttggtctagagccaaccgcttttaacaggccgttgcaaaaagctgtttccggctattctcccccgcagatgatggcgatggggatgatcccgcagcatcgtcccttgaccaccatgacgatggccaaataggccattgagggatgctggtcaggccaaatgagcgcaagccaggcactggcccagcccctgggggtgccatggccggtcttgacccgcatcagcaggccgagattgaaaccagccacatggaccagatagcgtttccggatgttctctcgtcctctgagccagacccggcgcatgccgccgcaccggtccagcgtatgctcgaagcttctttcgaccagttccgtccgctgttttcccatggccttcccgaccatcgaggatatccggattcggttgttgtacacggcgcgtcgcgcctcttggtcgccacgccaggagttcagaccgttgcgtttgggttcggcgattctcgtccgccatggtccaccgtccagaaccttgaggacatcccgggagaaatagcctttatccgcgaccagttccgcagggtcgtccgggcatggcggtgtggaagtgacccgccgcagactttcttgagcggctttcagcgtcgtttgcagagtcgaggtgtcccctttgtccgcttcatgcacctcggccgccaccaccgcgccggtgtccaggtccaccgcgtgctcgggcttgtacgccagatgcgttcggccatccttcatcttggcgatcttcgcctcgggatcgaccggtgaccgccagtccttgttcgaaagcgtcttgccgacgcgcttgcggtccatgcgagccagatcctcatctatcggagagtcgatgccgctctccttggccatgcgcaggagcatcttgcggtagctctcactcgtgtcccggcgcacgatggttttgagcgccgcgttggcctccatggtcgaagcgtccacgccaatgcggcctccaaggaccaagccatccttgctgagcagcttgagaacccaggtgaaaacctcttggtgggtcgccagtggcagacgggaccgtgtccggctgagcgaggaatgatccggcacagactccttgggcgaaagctggagaaaattccggagggaaagcgaatcagcgcagcgccactcaatgccgcgctcgctgtcgatgccctcgaaataccccacgaggtgcatccgaaaataccggccaggcggaatggagggacgccccttgtcggaatagaagggcttgcacagcttctcggcgaaaccatcgaagccggctttccggagaatctgctggagacgatcgtaaaaaacgtgcccacgagaccgagggatctcatcccaggccagatacatcgtcccctgctgatcaccctgacggccaagccccatcagatcacctccggaaccccgatggctggattctcggtcacttggcggagtttttcaacacgctgttagcgctggttcggcgagctctgccagggccggtgggttgggaagacagtcaggggtgttcgatttggcgcaagtcaaaatcgagcccggagacgtctcaacgccttttttcccgaggacaacggccgaagagttgcttctgtgcatgaggtattatcagtctacctatcccatgggaatagcccctggcacagccacggggaactacgggcctgaaggcggcgtcaaccttggaactgggcagactgacttctgggattttgggcagcggaagttctatgtgcccatgcgctccactccgacgctgaccttttacagccctgcgacaggggcaagcggcgttttacggaacttgaacaccgcatcagacatgacggcaaatacaatcttcatttcccctgcgggctatcgcgtcaatcaaaccggggcaacaggagcgaaccaggggtggtcatggcattggaccgccgacgccgaactctattaggtggcctacatgcggatattcataaacaacggttcgacgattcgttcttccgaaggggccgatattccggtcgatgcgcaaaacgggcaataccaacaatttttggcccttgaagcagccggcgaagccgtccttgttgatgacgccggctcgacgctggaggaaatcaagacggcacggatggccaaagtcacggcactgcgggaccagattcgcgcccgtggcgtcgctttcggcgctgcccgactggccgccatgcccgaggatcagggcacctacggcgattccatcacctacttgagttggaagcccgaaggcacccgcatcaaatggaaggcggcgacggggtggatcgaggtggacctggccacgcttcggacggctgcggaagtcgtcggcgacttcatcgaagcgctttttgacgccgagcacgcccaccatgtcgccatcaacgcgctgacaagcgtggaagcggttcgggcctatgacatcaccacgggctggccagagtaacagtcatgggaaccaagataaaacgctatttctggaacatcctccttggcctggaccagttcctttccgtcctcaccggcggcgatcccgacgagacggtttcgagccgggccggcaaggccgccgtcgccggcagccgcctcggccgtctgctggaggcgggcttggatgccgtcttcggggccggccattgccgccgctccatcgaaccggacgaagggggagaacgggtagcaaggtattaggagagagcaagaagaggagcggcagggcggcggacaccgccccaccgacgcgatgcgtgaacatcgcgccacggccgaagccgcgctccagcccgcgcgggcgttagagggctaccgcttccggcccaacctgtaaaggcaagcatggagatacgttgcggacaatgcggacgtttactggccaaaggcaccgggaccatcgaaatcaaatgcccccgctgccgcaccatcaaccacgtgagggccgcgagccccgaagaccgtcccgaaagggcagacaaggaatgctcgcgtggcccaacagctctttgacaacggcacgctttaccaaggcgacgccctttcgatccttcgggaacttcccggcgacgtcgtggacctggtgctcaccgatccgccgtattccagcggcggcttgaacttgtcggcgcgccaggtcaacccggcggcaaagtaccagaacaccggcaccaggagggtttatcctcccatgctcggcgatctcaaggaccagcgctctttcgtcatgtgggcgtcgttgtggctcggggagtgctggcggctggccagggctggcgcgtcctgcctagtcttcagcgactggcggcagctcccggccctgaccgacgcgatccaggccgccggctgggcgtggaaggggattatcgtctggcacaagcccaacgcccggccaagccttggttcgttccggcatgacgccgagttcgtcattcacggcgtcaaggacaggatgcaaacccatagccaccaatgtctgccgggcgttttcacgtatgccatggacccaaggcaaaaggtgcacctcacggccaagccggtgcgactcgtcaaggacctgcttgccgtgtcacccgaaggggccaccgtcctcgaccccttcctcggcggcggcaccacggccatggcctgtctggagacaggaaggcgctttatcggagtggaattatcaaccgaatatgccgccctcgcagccgcgcgaatccgcgccgccgaagaggcgttaaaaaactagagggagaaaacaggcggcgtgccaaacatagtgctaatcagtgccaaatcgcgcgccgccgtacatcgcaaaccgggggacaggtgggggacaaactccccgcccaacgcaaaaggggctggacctcatcagtccaaccccttgatttttatggtgctcccggcgcgaatcgaacgcacggcctatcgcttaggaggcgatcgctctatcctactgagctacgggagccggtcgacatatgaaacgatattcattcttccttcagtttgtcccggaaccgcgcccgaagctgaaggccatcttgcttatttcactggctttctcaagatgacagaaatgccgcgccgaaacttttgccggcaattcagccaattgacgcgcgacgaacaaactttactatttgcctcgcgaacgcttgtcaagaaaggctcggcagaccacacggccgaccgctgcccgccgctcccgggaaaaggcgcgcaaggccggccgcagtttacttcggaagaaactggcgtatacagggaaaaatcccctacgcgccgcaacaaagttcaacggcaaaagccacggacgcccgccatccccaggcgacgcgcccagcaacacaggagttccccatggcaagacgccttctcgccaccaccatcgccaccctgtccctcattgcctggaccgccatggcccaggcccgcgtccccctgcccgacatcaccgaactcgtcgacaaagacggccccgccgtcgtcaacatctccaccaccaaaaccgtcaaggcccaggaaggcatgcgcgaactcttccagagacgcggcggccagggcggccccatggacgacttcttcgaacagttcgaaaagcacttcggcccccagggccggggcggcggccagggcggcaagggccagaagcagcgctccatgggctcgggctttgtcatctccgccgacggctacatcgtcaccaacaaccatgttgtggacggcgcggacgaggtgaaggtgcagtttaagaacaacgaaaagccgctgcccgccaagatcatcggccgcgacgccgaaaccgatctggcgcttttaaagatcgaaggcaagtccggcctgccctatctggaattcggcgactccggcaagctcaaggtcggcgaatgggtgctggccatcggcaacccctttggcctggaaaatacggtgacgctgggcatcgtcagcgccaagggccgcatcatcggggccggcccctttgacaacttcatccagaccgacgcttccatcaatcccggcaactccggcgggccgcttattgacctcgacggcaaggtcatcggcatcaacaccgccatcgtggcctcgggccagggcatcggcttcgccatcccctccaacatggccaaggacgtgatcagtcaattgcgcgacggcaagaaggtccagcgcggctggcttggcgtctccatccaggacatcgacgaaaacaccgccaaggccctgggcctcgactccaccaagggcgcgctcatctcctcggtcatggaaggccagcccgcggccaaggccggcatcaagaccggcgacgtcatcacttccgtgggcggccagaaggtcgataacgccaatgatctgctgcgccgcgtggccgccatccgcccgggcgaatcggccgagttcgtggtcatgcgcaaggggtcgcccgtcacggtcagcgtcaccctgggcgaacgcgacgccaagaagctggcccagagcggccgcggccaggaaggcgaggacgacgccgccggcgaggacgcctcggcctcggccctcgggttgtccgtgcgggccctggcccccaaggaagccaaggccataggcatggacaaggcccaaggcgtgctgataacggaagtggccgacggctccgaggccgagcaggccgacgtccgcccgggcgacgtgatccttgaggtcaaccaacgcccggcgacctcccccgaggagttcaagaagatcgtcggcgaggacggcaagaagaagggcgtggtgatgctgcttatcaagcgccaaaaccagaccgtcttccgcaccgtgcccctggccgacgccaagtaacaccgccgcaacacaaccgccccccggcttcggccggggggcgcacaggcaacacccatggcgtctttcccctgccctatcgaggaaaccctcctgcccgtgccctgcaaggtcaatctgcgcctggccgtgggcgcgcggcggcccaacggctaccacgacatcgacacctttttcctgcccctgcccgaaccggccgacgtcctgcgtctgcgccgcttcgacggccccggggacatcgatctgcaatgttccgatcccgagcttgaaaccgacgacaatctggtcgttcgggcctaccgggcctacgctgcggccacgggctacgccccgcgtctggaagtccatctggccaagcacattccccacggagccggccttggcggcggttcgtccgacgccgccgtcatgctgcgctatttgaacgaccgggccgatgaagccgccctgtcgcccgtggacctggccgccctggccctgacccttggcgcggacatcccctttttcctgctcggcgtcccggccgtggccaccggcgtgggcgagacgctcatcccggccgatcccggcctggccggctggtgcgccgtggtggtgtgccccgaagcccgggtcaagaccgcctgggcctatgccgccctggacgcctcccgggccttgccgcaaaaacctggggcaaacctcttgacaactgcttttgacgccaataaaagggcgttttgcgtcaccggtgcgcccatgcggaacgactttgaaagcgtcgttttcgcggcccaccccgaactggggcgggtcaaggagcgcctgctggcccttggggcagcgggcgcgcttttatcgggcacgggttcggcggtgttcgggcttttccgcaagcgccagacggccaccctggccctggccatgctcaccggaagcggcccgcgtgcctatctcgcgccgctgtgacgcacgcggcccctcggggccgcgcggccggtccgccgcaatagaccattttcatgctggggcgtcgccaagttggtaaggcacggggttttggtccccgcattcgtgggttcgagtcctaccgccccagccagtttttctccgacaccacccggtccctcccggaccggcacagcacccgaggcttcgcacatggcgcaaggcgatctgaaaatcctcaccggcacttccaatcccggactggccgaggccatctgcgaccatcttggctgcaccctgctgccggccaaggtcggcaccttcagcgacggcgagatccgcatcgaggtaggggccaacgtgcgcggctcggacatcttcgtggtccagtccacctcgtacccggtcaactacaacctcatggaactgtgcctgatgctggacgccttaaagcgcgccagcgcccggcgcgtcacggcggttgtgccctactacggctacgcccggcaggaccgcaaggtcgcgccccgcgcgccgattagcgccaagctcgtggccgatttcctgacggttgccggcatgaaccgcctgctcaccatcgacctgcacgccggccagatccagggctttttcaacctgcccgtggacaacctgttcgccgcgcccatcatggccgaatatttcaaggatttctccggcccgggcttgtgcgtggtttctccggacgccggcggagtggaacgtgcccggtcctttgccaaacgcctcggcgcgaccctggccattatcgacaagcgccgcgacgcccccaaccaggcccaggccatgcacgtcatcggcgacgtcaaggacaagctgtgcgtggtgctcgacgacatgatcgacaccgccggcaccatgtgccaggccggcgtggtgctgttggaaaacggggcccgcgaggtcatggccacggccacccatccagtgctgtccggcccggccatcgaacggctggagaattcgccctttacccagatcgtgaccaccaacacgattccccttaacgacaaagccaaggcctgctccaagatcaaggtgctctccatcgcggggcttttggccaaggccatccacaatatccacaccgagtcctcggtgagcgtgctgttcacctaatcgggcgacgcacggccggccgaaaaaaccatgtttcgccccagggcgcaaaggagatacccgatatgagtcagacccagtccctcgccgtcaagacccgcgcgggcctcggcaaaggcgcctgccgcaagctgcgcgcagacgatatggttcccggcgtttactacgacgccaagggcgtcaacgtcccggtcatggtcgagcacctgcccctgcagaagctctattccaagatcgcctcctcccacgtcttcgatctccagatcgagggcgagaccaagcccgccctggtctggaaggtcgagcaccatccgaccaagccccgcattacccacgtcgatttctacggcgtggatctgaccaaggaaatccaggtccgcgtgcccgtcgaagtggtgggcaagtccaagggccaggtcaaaggcggccagctggagatccaccgcgagttcatcgaggtcctctgtctgcccctggtcatcccggacaagattgtcctggacatcaccaatgtcgacatcaacgagagcatcctgatcgccgacgtcgtcctgcccgagggcgtcaaggctgtttacgacaataactatgccgtcatcggcgtcctggccagtgcggccgaggccgccggcgaaggcgcctagccttcgccaggttccgttttcgcgtatgcggcggggtgcgttttccggcgcgccccgcctcttttcgcgcgaaagccccttggtttccccacctgccatggccgtttccgccatcatcgtgggcctgggcaatcccgggccgagatacgccgccacccgacacaatttcggcttcatggtcttggacgccctcatggagcgcgcccggcaactcggcggcgcgcccaaggcgacgctgaccggccgcaaggacctcgaagccgtaaccctttccctgccggtgctgcccggcggggctttcgcccagtttgcctgcgtcaagccgctgaccttcatgaacttgagcggccgggccgtgcgggctgccctggatttctataagctcgccccaaccgacgtctttgtcctgcatgacgagcttgacctgccgctcgggcggatgcgcctcaaacgcggcggcggcaatgccgggcacaatgggctcaagtccatcaatcaggaactgggcagtccggagttcgtgcgcctgcgcctgggcatcggccgtcccgagggccgggacgtggccgggtatgtgctcgaagcctttcgcggcgacgaaacgcccgtggtgcgccaggtcgtaccggcggctgtggacgggatcatggcctttttcgaggacggccttgaaacggctcagcgccgcgtgggcggctttgacgccgtgcccccgccgttgccccagccgtagcgcgtttcctcgccatgggcctccctcgtcttggggcaggacgcgaagagcacgaattttccagaacaaaaaccgacgtttttgcgtgggcaccccgggtgtggcggaccatccgctgtttcgcccctggtctgcgggcaaaagtcgcatttttgcaaatccccgtcagcccgcctccgccctggggcggcccccttttacaggctccaacccttatgggaagcggttttccggccatcgccggaatccatggacacaaggggacaagtacgctattttgtattgaagacggtacagacgttgtatttggcgagcgtctggccgggaggagtcccacggtgttttccgaggagcagctagtcgtttatccggcccagggtgtgggcagggtcgaacggatcgagacccaggtcatcgggggcgcctcggccgactttttcattgtgcgcatcttgagcaacaatgtcaccttgatggtgccggtgaaaaacgccgccaacgtggggctgcggcccctgtgcacggccgaacagggcgcggccatcatcgaatccctcaaggaccgctccgacttcaccggctataccggccagaactggaaccgccggtaccgggagtattccgagaagctcaaaagcggcgatctggccgacgtggcctatgtgctcaaggaactgttgctcattggccagaacaaggaactgtcctttggcgagcgccggctcctggaacaggcgaccagcctgctcaccctggaactggccctggccctggacaaggaccagcaggaaatcaaagacgtcattaacgagatcttcgccgacgtcctgcaacccaaacctgaagaataggaccgcgatcccaagactttgggcagtcatgggccgacccgcccttgacacacccgcgaaaaagtatatggatcgttccaggccgttgccggcctatcctccacttgccttggcccccgtaacatagcgagtcgcccgctcctccacaggggcgcggacgcgacgaactcacgctgcatcgggttttcacacactatcaatatgcgcatttccgcgccgggctatttctgtgagcaatgcacccaaacgccgcgggcgaaatcctcagccggcccctgcacccgtgctttccgatcccatcgaaagcgacgacatcctgcaacccgccgctgtaaagtccagtctcatggagggcaactccatgaacctttccgagctcaagctcaaaagcatgcccgagctcatggacttggcggtccagtacaatgtcgagaaccccaacggcatgcgcaagcaggagctcatcttcgccctgctgcagagctgcgcctcccaaaacggggccatcttcggggaaggcgtgctggagatactgcccgacggcttcggcttcctgcgctcgcccatgtacagctacatgcccggcccggacgacatctatatttcgccctcccagattcgccggttcggcctgcgcaagggcgacgtcatctccggccagatccggccgcccaaggaaggcgagcgttacttcgccttgctacgggtcggcgaaatcgggttcgcgccgcccgaagcctcacgaaatctcgtgctcttcgacaacctgacgccgctatatcccgacaagcgctttgttatcgagaacggcgcagaaaactactcctcccgggtcatcgatctcctcgcccccatcggccacggccagcgcggcatcatcgtcgccccgccccgcaccggcaagaccatgctcctccagaccctggccaactccatcagcgccaaccggcctgacgttttcctcatcgtgctgctcatcgacgaacgccccgaggaagtcacggacatggagcgcaccgtcaaggccgaggtcgtctcatccacctttgacgagccgccccagcgccatgtccaggtcgctgaaatggtcattgaaaaggccaagcgcctggtcgagcgcaagatcgacgtggtgatcctgctggattccatcacccgcctgggccgcgcctacaacgccgtcaccccgtcctcgggacgcgtgctctccggcggcctcgacgccaacgccctgcagcggcccaagcgctttttcggcgcggcccgcaacatcgaaggcggcggctcgctgaccatcatctccacggcgctcatcgacaccggctcccgcatggacgaagtcattttcgaggagttcaagggcaccggcaacatggaaatctacctggatcgccatttgtccgagaagcgcgtcttcccggccatcgacatcaaccggtccggcacccgcaaggaagagctgctcctggaccccgacgtccttaaccgcgtctggatcctgcgcaagctcctggcccccatgagtcccatcgactccatggagtttcttctgggcaagatgcgcggcaccaaaagcaaccgcgagttcctcgacctcatgaaccggtagaccgccggttccccactgccgaagacaaaggcggatcgcttacgaggcggtccgccttttttgccgccttggcccggccaggttttcttaagggtttttaaccaaagccgccgggtgctttccttcccggccggttcggcgtataggccggccatggacgccccaagcttgcatcgccggccgggcgcgacccggcggctggcggcgaccctggtcgcctgctggctcatcgtctccctgctcgccccatccttggtccaggcctccttcttgtcgtttgacctcaaggatgaacgggaactcggcgaaaaattcaacatcatgatccggtcccggatgccgcttatcgaggacaccgagatcaacgactacgtgaccggcctgctggaccggctgaccaggaccatgccgccccagcccttccccttcaccgtcggcatcatcaacaacaacgccgtcaacgcctttgccggaccggccggctacgtcttcgtcttcaccggactgattctccagatggagcacgagtccgaggtggccggcgtcctggcccacgaactggcccacgtcagccagcgccacatcgccaagcgtgtgggcgaaatgaagctcctgagcatcggccagctcgtcggcgtgctggccggcgtggtgctgggctcggccaccggcaaccaggaccttggctccctggtggccgtgggctcccaggccgccacggcccacgcctatctcaagtattcccgcgatgacgaacgcgaggccgaccaggtcggcatgaactatctggtcgccgccggctatccgccgggcgggctggtggaagccttcgaaaccatgaaacggatgcgctggatgcagggcggcggcgtcatcccgacgtatctcagcacccaccccggccttgaggaacgcatgggctacctcaaggaccgggtgaaaatgctgcccaaagatgtccaggaccgcagaaacaacgacgccgccttcaagcgcgcccagatgctggtgcgcgcccgctataccgacgccaaaaacgccgtggcctacttccgaaaacttggcgacaagatgacctgcctggacaagctcggcctggccatcgccctgtcgcgctccctggaggacgtgggacaggcccgggccgcctttgacgaggccgtggcctgcgccccgaacgatccgctggtcctgcgcgagacgggccgctactaccttaaagtgcgcgatttcgcccgggccaaaagcctgctcgaagcggccctgcgccaaaaccccaccgacatcgacgccaatttcgaatacggccggatgctggcccaggaaggcaagccggcccaagccgtggcctatctggaaaaagtccgccagcgggtgccggaaaacgccgaaatccggtctatctacggccagatactgggtcagtccggcgacctcttccacgcctatctccagttgacctacgccgccgtctacgacaacaatcccccccaggtgaagttccagctgggcaaggccaaggcggcggccaagaccgacgccgatcggcgcgagctggccaagcttgaagaaaccatcaagaaacgctccgaattctggaaaaaaaggatcatggaatgaacgactcgctgctcgtgcgcctgcccaagggcgaagacctgctgtccgccctggtggccatctgcctggaaaaaaacatcaccaaaggccacgtgagcctcattggcgccctggaaaaagccgaactcggctactatccccaggacacccgcaaatacgtcacccacaccctcaatgaaggcacggaaatcctggccggcctgggcaacgtgtccctgaaagacggccagcccatcatccacctgcacctgacgctgcttaagggcgatttcaccatcaccggcggccacgccatgcccggcaacatcatcttcgccggcgaagcctgcatcacccctatcgaaggcccccgcctgcaccgcggcctcgacgccgctaccggcctgcccctgtgggatcagaccgggatgtagtgaagggaaaaaggaagaataagaggaagatgcctccggcggccgggaggggctcagcccctcccggacccacccgaaagggggaaatgaggatgccggaggatggtgtcgatggggtattcgcggccagcggccatgcctagggccagcagctgtccttgccggccggggccgccttgccggtcttgaggtccagccgcatgggccgcgtcgccgtcttgccggccgggcaggccggcttgcgcccgctctcgattttttccccgtaagccaggcttcccgaagccaccgacgctcccggaatcaccgtggcgtccagggtctgcttctgggccgccagattgaccgccataaggccgtgcagaccatcggccggaccgttggtcacgaacagcgtgtcgcccgacaggccggcgaaggcgaagtcgccgccgttgggaatctcgaacagcggccgcccctgggccaattcgcagaccgcatccggcgaatccgccgccgtgtgggccgaaaccttaagcacatggccgtcggaatagccggccagggactccaccacggcgtagcgcggatagaaatagcaggtgcggtcgtggtaggcgtggacctcggccaggtccgtgccgggcagccctgccgccttgccgcgctcgatggtcgtggccccgtattcggccgtcatgggcgtcacgtcatccacggccagcaccttgtaggtgaccccgtttcgcaccacgatctcgcgcaccaccccgcgcacccgcaccttgatgtccagcaaactgttcatgatgctgccccggtcgaagggcacgtagaccaccccgggttcctgggcgctggtcagttcgatgccgccctggggcgtttggcgcaacatgccgtagaccgtggttttgcgggtttcctcctgggcctggccgacgcccggcaggacaagacagacgcccagggcaaaagccagggccatgaagcgggtgaacatgcgacgcataacgcctcctcggtggaatggctctcgggtatcagagccggcgcgttttgcaaacgcgggattcccgatcatcgcggttgaaaaaaaaccgcgccagggtatgaatgaagctactggaggccggcatgaacgacgcccaacacagcggctcgcggcagacctggaaaaactggctcatcgccatccttttttgcatcgcggccggcgaattcgtcctgctggcccgcgcgccggccccaacgccagagccttcagcgccccaggccccggcgaccgtccaggccccggcccaaccggccgcgccccagaacctcgacgccgtgcgcgtggccggtctggccatggaccccgagcgcggccgctatctcctaaccgcctttgaccggcccgtgaccggggcccgggaaggagcctccccggccgccgatccggccgccatcgagccggctctccccggccgctggacctgggtttcgccctacatgctgcgcttcgagcccaaggacggctttgcccaggccacggtctacaccatcgccttcaagggtcaggatttcctcaccccgccccagaccctggccggcaaggattcctggcaggccagctacggcagtttcgaagtggccaggctcaccgcccatctcgaacccgccccggaaggcggggccatggtggtggttcgcggcgaggcggcctttaaccgctccgtcgatcccaaggccctggtcaatcatatcaagctcattgatccccgcgccccggacaaacccgtgtccgtgtcgctcaccaccacctacgccgccaagaagctcgaattcgtctccgatcccatcgaaaagaccccccagcagcgcgacgtaaagatcgtcatcaccccggggctgcggccggaaaagggcagtttgacccttagccgcgaggccgtggccgtcatccctgtggccctggaccccaatttgcgtctgcgcgaggccaaggccgtgtccgaggaaggcatggccgccgtgcgcctgctcatgtccacccctgtggaagcgggcgaggccgcggccggccacatccgcgtcgaaccggacctggccaccgaactgtccgccgacggcgcggaactgattttgagcggcgaattcgaacccggccgggaatatgccgtcaccctggaaaaagggctgaccgccggtgacggggccgtgctcggcgagacggccaccagaaccgtgcgcatcccggatttggccccgtcggtcgatttccgcgaccagggcgtgtttttgtcgcgaaacggctacaagaacctggctgtgaaaagcgtcaacgccgccgccgccgaggtgtccatcgaccgggtctatttcaacaacatgttcccgcttttcaccatggactactccgccttcgaggacgactacggcggcggcggggtcaactccaacctgggcgaccgcattttcagcgaccgggtgccgctgcgccacaagagcaacgccgccgagatcaccccggtcaatctggaaaaatacatccagggccatgagccggggctgtaccgcatagcgctcaccgtcccgggcaagttcgagggctaccagcggttcgtgtgcctcaccgacatcggcatcgtcgccaagtccggccccggcgacctgctggtctggaccgcctccaccaccaccctggcccccctggccggggcttcggtcaaggtcttctcccaccagaaccaggagatcgccgccggcgtcaccgacgcccagggacttttccgggccaaggtcaatccccgggccaactacgacaagcgcccctacctcgtcgtcgcccaaaaaggggccgacgtgagcttcctgctgtacgaccgcttccgggccgacgacgccggcctcgacgtcggcggcgcggtcatgccggccacgggctacaccgcctttgtctacggcgagcgcgacatctaccgcccgggcgagaccctggaagggctggccgtggtgcgcgacgtgcgcctgggcgtgccgccctccatgccggtgctcatccgcctgtccgacccccagggccgcaagatcggcgagcaggccgccgtcaccggggccgagggcgtggtcagcctcaagcaggccctgcccagccaatccctgactggggcctacagcctggaaatcgtcaccggcgagacggtcatcggccagtaccgcttccaggtcgaggagttcgtgcccgaccgcatcagcgtgtcgcttagcgccgacacggccaaggccgaactcggccagcccgtggcctttggcgtcaccggccgctacctcttcggcgcgcccggggccgatctgccggtggaagcccggggccggctcgtcaaggccgccttcgcgcccaagggctacgagcagtacgtgttcggcgacccggagcgcagcttcgaggacagcgaattcttccaagaatcggctaccctggacgccgagggcaaggcctcgttcacggccgaactgcccggcgacctgtcgccgccggcggcgctggaagccgtcttcacggcccgggtgcgcgagggcggcggccggggcgtggccgggcttgtgcggatgccggtccatgtctaccctgcctatccgggactcaagcgcctggccagcgacgccctgcccccgggcaaaccggcggcgttcgagtgcgtgtccgtggccagcgacggcaagcttgccgccacggcgaccctgtccgccaccctgtaccgcgacgaatggcagaccgtgctgcgaaaggacggcggaaccctcaagtacgaatccgtgcgcgaccccaagcttgtggaatccaaggacgtggcccttaccgccggcaagggcaaggtgagcttcactccgccatcgtttggcagctaccgcgtggtcctcgaagaccccgaatccggggcggccacccagctcgaattctacgccggcggctttggctactcgccctgggccatggaaaacccggcccgcattgaactcaagaccgacaaggccgactacgcctcgggcgagacggccaaggtgcaggtgcgcgcgccctttggcggcaagctcttggtggccgtggaaggcacggccatccacgacgtccagatcgtggacctgcccggcaacaccggcgaggtgctggtgcccgtaaagcccgagtatctgcccggggtctacatcacggccacgctcgtcaaaaagacggcaagcgtcgtgcccggcacgccgtcccgggcctatggcgcgacccccatcggcgtggacaaggcctcgggcaagctgccggtggccatagccgcaccggccgagatccggcccggcacgaccctggctgccgaggtctcggccccgccgggcagccttgtcaccgtggccgccgtggacgagggcatcttgcagctcatcgcccagaagaccgccgatcccttcgccgccttctacgccaaacgccagttgcaggtggagaccagcgacaccttcgccctgctcctgcccgaggtcgcgcccatagccggcaaggccctggccggcggcggcgacggcctggaagacctgtccggattcgtgcgctcccagagtccggcggcccggactgtggccttctggtccggcccggtgctggtcggccccaccggcaaggccgaggtgcgcttcgacatccccgagttccagggccaggtgcggctcatggccgtgggcctgtccggccggcgcttcgccggatccgaggccaaaaccatcgtcaagagcccggtggtcgtgctgccgagcttcccgcgcttcctgggctttggcgataaggcccaagctatgcttaccgtgcgtaacgacaccggcaaaaacggcgacttctccgtggccctgtccgccacaggcccggtgtcggtggtcggttcgccgcgcatcgtgtccatccccaaggggagcacggccaacgtgcctttcgatctgaacgccgcccaggccgaggggctggccaacctgtccctggccgtttccggcaacggcgagaccacggccgacaccgtgtccctgccggtgcgttcgcccctgccgccgcgcacctcggtgcgctcgggagcccttgaaacagccagcctcaccatcccggagctggcctcgggcgagtttctgcccggctcggccaagcgcgacgtggccgtggggccgtatccgctcatccgcttcaccggcaatttgaagtcgcttctgggctacccttacggttgtctggagcagaccacctccaaggccttcccgctgctctacttcgccgatctggcccgggccatggacccaggcagctttgagagagacaatccggccggcatggtcttgtccgccatccggcgcatcaccggaatgcagctctataacggcggcttttccatgtggcccggcggcgacgagccccaagcctggatgagcctgtatgccgcccacttcctggtggaggcggcgacagccggctatccggtggacaaggaagcccaggcccaggccttgcgctttgccgccgagaccggccgcgaggccaagcttgacgcgcccgacggccccaagctggccgcctacgccctctacgtccaggcccgggccggccgggccgacatcggggccatggacaacctgcgcgacgcctcgggcaagcccctgcccgccgaggcgcgcgggcttctgggcgcggcctacgccgccgtgggcaacgcccgggccgccgacaggctctttgccggcccgccgccctcgggcgaggcgcgcaaggagaccggcggaacgcttgattccaccctgcgcgacaaggcgctctacctctcggccctgcttgacgccgccccggccgatccgcgcctgggcagcctggccgtggacgtgggccggcttctggaaggcgaggcctatccgtccacccaggaaaacgccttcgcgctcatggccctgggcaagttctacgcccgccagcaggccaaaaagccctttgccggcaagctctacgccggttccgggctgctctccgacgtcaccagcaccaaggtcctgagccttcggggcttaagccagcccggcgatctgcgcctggacctcgacccgggctaccagcccggcagctgctactatgccgtgcgcacccggggcatcccctcggccgccgcctacagtccgcaagccgccggcctggaaatcgcgcgcagctacctgacccgcgacggcaagcccatcgagggcaacaccgtgccccaaggggcgctggtggtggtcaagttcgccgcccgggccaccgccggccctgtggccaacgtggtgctcgaaaatctgctgccggccggtctggaagtggaaaacccgcgactggccaccaccgagcgcctgccctggatggaaacgccgggcgagggcgaaaccacccacctcgacctgcgcgacgaccgcatcctgctcttcgccgatctgcaaaaagacaagtggcagacccactacgccctgcttcgggccgtgaccccgggcgttttcagcctgccgccggcccaggccgaggccatgtacgccccggaactgcgggccagcggcgagacgtcaacctttaccgtcgtaccggccgggagatagcgccggctttgtatggaaaaattcaaacgactggttgcttcgtgcgtgcgcagcaacgtttccgatttacacctgcgggcggacaagccggcggccgcccgcaaaaacggccaactgcactttcagcgcgacatcgtctttagcgccgcggaactcgacgagctgctgaccagcctgaccaccgaccgccaacgccgcatcctggccgaacgctggtccgtggacttctcggcccggctgaccgagtcgcagatgcgcttaaacgccttccacaccgccgatggcctggggctggccgtgcggtttctgccggcctcggccccgagttttgaggatttaaacctccatccgtccctgcgcgccctgtgcgcccggccttttgggctaatcctcatctgcggccccacgggcaacggcaagtccaccaccatcgcggccatgctgcgcgagatcaacgagacccgcccggcccatgtggtgaccttggaagaccccatcgaataccgcttcgtctctgaccgctcgctcattgaccagcgcgagcttggggcgcacttccaaagcttcgagcagggcctccaggacgtgctgcgcgaggatgccgacgtcattgtggtcggcgagctgcgcgaacccgagaccatgcgcctgaccgtaaacgccgccgaatccggccatctggtcatcgccaccctccacgccgccacggccgaggaagcgcttttgcgcctgtgcaacgcctttgccccggacacccaggactttgtccgctcccagttggcctcctgcctgtgcgcggtggtggtgcagcatctggaatttttgcccaaggccggctttcgcgccccggtgctgtccatggccgtcagcgctccggccctgcgcaacatcatccgggaaaaccgcttcaaccagatcgaaaacctgcagcaggccggccgggccgacggcatgttcaccttcgagcgctaccgccaggaatttctggaagccaaggccagcctgaccccgccggccctggcctttcgggcctcgggccaggccgcgccgcccatccgtccggctccggagccactcgggctgagtctgaccccgccaccccaggccgcccccggcgaccccgggccgcgccagccgccaaaggccgtccacgaactcgaaggcgaagcccctgaactctaccgcatcgacgacgctgtttccctggaggaactggtggcccagatgcacggcaagaagccctgaggccgggaccggcaggcaagcttcgccgcccaggcccgttgagggccaagaccatcgtccgggtattgcggcgggagaagcggaccgtggccgacagcacgacagcgatgagcgcgaccgccggggagctttgcccgacaatcacgacgccgtgagcgacttgcggggaagagccgcgcggcccgggcttcatgactggctgcagccgacgccggccgccaccagcgccacggcccgggacacggtcgcgccggcatagagcatggccacgtgggagaccggctcggtgcgctccagctcccagcccggccggtcgggaacaagcccgcggtcgggcacgaccagattgtccacgggcgaggccagggcgaccagccgcgccccgggcggagcgggcaaggcgttcaagcagccaaacagtttactctccggggtcagcgaccggccaagtttccccacggccagccgggccaagacgctgccctggtgcggcgtgccgagcgtcacgaggcaacgggtacggccgcaaaaatcaggttcggcagccagccgtcgggccatgaggccgcccaggctgtggccgaggaaacagaccggagcgcggggcggcacgagttcccgcagacgcacggccagccgggccgcctcggtctcgaagtcgtcccgaaagctcggataccccagaatcagcacgcggttgagcccggaccggccaagagcccaccggatgcgccagaaggccgaggggttgtggtaaaggccatgcaagcacacgaccaccggggccgtgtcatcgacctggctgttcccgggggggccgggttggcggcgggactggagcagtggccccaggggataggcggccaccatgatcgcctgagcggccagagccgaggtcagccctcgtaacacgcaggcggtccgacgtccggggcagccccgggacagcagcacggcccgtccggccagggcaaaccagccaaacgcggcgtagctcaccccggccaccaccgcgcccacggccaagggcaaggcgatcagccagccaaggatggtcatggggcgtggcctccctggccggcggcctttttgagggctgtcatttccctgaaatataaaatgaaaatcaaaacgtcaaacgcctgataaaaaacctgttgacggccagggcggagatgcgtagataccgtttctcgccgggcgggcgggtagctcagtcgggagagcatcggccttacaagccgagggtcacaggttcgagccctgttccgcctaccacgagtttgtcaatgatctggggccgtagttaagctggttataacgccggcctgtcacgtcggagggcgcgggttcgagtcccgtcggccccgccagatcacaccagacgccacgcgtctgtcgggacctcaaagcgcagtccctttgaggtttcttatttgaggctccattgcctcgcggactgcacccctgatctggggccgtagttaagctggttataacgccggcctgtcacgtcggagggcgcgggttcgagtcccgtcggccccgccagatcacaaaggcgcttgcgcctgacaaggccctgaaggcgacaccttcggggccttttgttttgctcggcctcggcccggggcaaacgaccgcttgcccgctgtcgcggccctgaggaaagacgaccttggttcccggaacattcgtggtgttcctccgtttccggcagcatgacggacgcgctgaccaaggccctgacgactcccgcccgcccgggtccggcccaaggagaccgccatgccgcccaaacgcctcgccgattccgtgcctgtctactccaccgacaccggccgcctgtgcccgggctgcggccgtgccccgaccgcctgcgtctgtgccgccgccaaggctccggccggggacggtgttgtgcgcattagccgccagaccaagggccgcaagggcaagggcgtgtgtctggtcaccggagtgcccctggccggcaagggactcgaggccctggcccgggaactcaagcagcgcctgggctgcggcggcgcggtcaaggacggcgtcatcgagatccagggcgacaaccgggacctgttggccgccgaactcaaaaaacgcggctacgtcgtcaagctggccggcggctgattttctcacttcacgccgcccaccgtttcctttcgcgtcgccgtccatcccctgcccggcgcgtcatcaacggcgcaagcccttgttcacccgcccgcgcctggacaacgcccttggcctcgagcgtttcgagcatggactgatgctcgctcgccctcgccgccctacgcctgcgcctgggcaacgccttcgcgcctccccctcccctcacgcagcatccggccaagtccccagccgctccgtcgcccttgaccagccagacgcgccatgccacaagcaggctgcgacaacggcaaaaaccgacgttatgttgcagcaacgcgccattgttcgcgccatttcatggaaaagtcgtaggaaatcctttgcaacgccagccaggagaccgccatgtcccgcacccgccgcgtcctgatcgccgtactcttcgtgtccctgctgttttcaagcctcgccctggccgccgaaaaaccggctgacgagaaaaaacagaccaaggccggcctctatgtcacggccaaggaagccttcgagcagtggagcgccaataaggacggcataaaaatcctcgattgccgcacccctgaagaatatgtcttcgtcggccacgcacccatggcccacaacatccccagccgctttctgacctacgacttcaacgccgagaaaaaagaatacgccatgaagcaaaacgacggcttcgtgacggctgtccaggccaagttcaagcccgacgacgtcatcatgatcatgtgccgctcggggcagcgcagcgccgagagcgtcaaccggctgaccgacgccggatttgccaaggtctacaccattgtcgacggcttcgagggcgacatggacaaggaccagcaaagcccgaccttcggcaaaagggccttaaacggctggcaaaacgccaaactgcccgtaaccttcgccctggacccggccctggtctatctgcccaagccgtagccggcggccccggcggcgactggcgcgagtccctcctgcaaacgccatcagccaagccgctgcccgccggccccagcggccggcctcccggcctgccgcgcttcccatcacgcggcgcgccgcagggtccatccgtttcccgcaaaaggcaacgcgcccggacttgcatggtccgggcgcgttttgcgtggtcggcggcgcgacgccagccggtcttttcatcggaagcccgcgtcgtctgtctcgcttgcggccgccctcgggcttgcatccccgaggatgaccgaaagccggctcgttcgagtttcttaaaaagacgtcaatatttccacaaccgaatggtcttagcctgctgcctgcaaacagtccgagatgcccttcgtgacaccgcgcctaaaacttgatggcgaacgaagcataaaccgtgtcgccgatggggctgttggacgcgcccaggccatggagccacttggtcacgagcatgagttccttgccggccacgggcacggtgtaggtgatggccgggccgatgcccgtgcccgaggagagaaaggagcccatcttggccccggagccggaatccggcgtggtctgggcaaagaggtagcccaccgcgcccagggccaggcgctcgttgaaatggtaggccagggtccaatcggcgtggatctggttgccggtcaggtagctggtggtctggttttcggtgttgatcatgtagccggcgttgaccgaaaattcgatcttgctcttggaaagccaggtgaaggccacgttgccgtcgaagctggcgtagttcatgccgaggttggtgagttttttgggattatagtagccggtgggcaaaaagatgatgggcgacacgaccagatggcattcgccgaagttccagccggcgataagcggcatgagaaagatgtcggacagcccgccccggtcgccgccgccgccgtaggccaggtgatggggcgtttccaggcccgttgtgcgcgacttgtggttccagtcggcggccagatcgccggtgatgtgctcgtttaagatgatcggcacgcccacgcccacgccgaggaagccccccatggccggcacgtcgaacaggtaggaaagcttggtgaggttcatcgccatggtggaatcgaccccggcataggcccggccgcctttgagggacttatccatgtgggcggactggtagaaggtgtcgtttcgcacgtaaaacccgccggccgggatgtagcccatgaggaaatcgccgtaggcgccgaggatgtagtggctcaccccgccttcggcggcccgggccggggccggcgcggcggcgcaaacggcccagacggccagggcgagaaggagtcgtgcgacgtgaagacgtccggcggcgtttggaaaagtcggcatggcggcatcctttggcgcggggttgcatgttgtgaaagcgtgtcgctagaaaagcttgggcaaaatcggcgtcagcgtgaacttgaacgtccactccgtgcccgtgtgacggggccggaccaccgaataatcggcctcggccgaaagcttgaccggcagctcgcccagggtgacgagcttggccacacccaggcccacgggcagggtcagggcgttttccgccttcttctgggtccagtcgatgaggatgttgggcgacatccccacctgccaggtcttggccggggaataccacaggaaatactgcgccttggtcagactcacttccttgcggtcgggatcgccgcccacggaccaccactgttgcgggaagatgcccgccacccaggtcgcatccatatagacgagggccgccgcgccgccaagctgccatttgccgttgcccagatgcttgtccgtggctgtgggaaacaccgccgtgggtccgaggccgaacagcaagccggagctggatgaggccggggcgaccatggccatgaattcggcgtcgccaaggccgaaacgctcgtcggtcttgtgcaggccggcggcgtagggcgtgttgtagaccgggatcagcggccgggtgatgaggcgcaggtcggccggcaggtcgaaggtcaggacaggctggaaattatagttgaactggctctttgcctgtttgaacgcgccgcccttgggcgactggagcaggttgaggttgaactggttggtgatcatccacaggctgcccacggggttgctcgattcctgggtgagcttttgcatgtcgtcgtcgctacgcggcggcgacgacgactgggccgcgacagtgccggcaacggccagggcaagcaacaagacaagagccgaagagggaaacagacggtgagacatggaggcacgtccttggggttggggcgcacagccggggcaggcgtttgaacaacaaaacagcaatcggcattgacaggcccgggcagcctcgtggcgagggctgtccgggcctggttcgtccgggcatcagccggacactatttaaaaggagcagcctggccggtcgtgtccggataatccaccggaataaagaccgggatggcgcttatgcccttggccccggccagagccttggccacgtccacgtaacgccagttcttgttgtccatgctgcggtaatagtagcgaagccgggccgtgtcggcgacgacagaccagatggtcttgtcgaagcgttcttgcccgccctcgaagccgcgcaccgcgccgatggggatgtccacgttgtcgagaatggtgatggcctggttcaggccggcgtccgcgcccttggccggcagggccgcctgggacagggccaccatgcgcacgaagcggctgggcgggctgtagtccccgggcaggccgtagaggcccgaaccctggccgaaagtcttgagcgtcaggcccttgagcttcagctcgggcgtgttgaaggtcgagaggttgatgtagttgtcgaggttggtgagcatccagtcgaatgtcggggagttggtcatgacgccgagcggattgtcatagagggtgacggttcccttggcgtattcgatgaccacgcagtcgcccgaggggtcgtggacgacgtagtgcaggggcagcggtccggcgtcgcccaccggcccctggcagacccgggcctgccggtagcccttacggacctcggccacgctgccgaaactggacaacagccaggcgccgaattcgtactgggccagggtcttgccggccttggtgcggtcgaagggttcataggtcacgtagccgggcaaaaaaagcgcgccgaccactaagcccttctcgttcatgccgtccgagggaagcggcatcccgaaatcgaacatgccgacaaaggcgtgcttgaccttccaggcaaggcccttggaagacccgtcgggcagagtgccctgataggccgtgccccggggcacgatgcccagcaccgtttgcagcgtccactccccttccatggtgcgggcgtaaaagaccagtccgtcgctggtcttggtgcgcacgctggtgcaggcctggcccggcgcggcggtcaggatggtcaggaacaacacaaagagcagcgccgtcatacgtcgcggcatgggcatcctccccggaaacaggttacgcgaaagccgcgccgacaaggcgcgacaaggcgcggtcgcgccatgcgtagcgccggaacgcggttttcgcacaaacgaaaagggaaaaaccggctctttgcaacacgccaggatcagacgaacacgctgccggggtcgattcgtgaaacgtgtcctgtcacgaaagcattgccgcgaaaacgtgactgcaccgaaccggcgctgattcctttcctggccgacaacataaaagccaagacaactattccgatttcaggaatcaaggcaagacaaattcccaaccccggccatacagaagggcaacctatgcaatggaccgcgtgttggtgtttgtgcagacaggccgcaggctacgtcaattagccggacgtcgagtacccgggcgtccgaggggccggccaatgccgatctccagaagatcctcgccgacgatgagccggcccgggaagtcgcgcttgatggcctggaaacgccagggcggcgtgttgcccggggcgatgtggctgagcaccagcgttttgacctcgcaggctgcggccacccggcccagatcggccgaactggtgtgggcggtcatgacgtggtcatacagcggccaggccggatggtttcgatccacgccggcaaaggcggactcgatccaggcctgatcgatgacctcgtggaccagcacgtcggccccccgggccaggcgctggaggttgccgcgcgtgtccggcccggtgtcgccggagatgacgacgccgccgtcgtcggtgtcgaagcggtaggcaaagctcgggtagacctggaaatggtccaccagcacggccgtaacccgcagccggtcgtcctcgtacacggcaaagggctccatggccggacaggtgtcggcggcggtccagggccggccgggatcgggcggaacaaagccggccggccaggagatggttccggggtcgccaatctcccggacgtcgagaatgcgggtcaggtcggggtagccctcgtcgcgggcgcagtcgttgaagttctgggcaaaggcctcaagcaacagctcggtcatgcgtttcgtgccgggcgtgggcgtggccgggcagccgcccccggcctcggccgtcatgatgccgccggcgtagccggaatggttttcctccagccgcccccgttcgcccgggccgatgacgacaagctccttgccgccgccgtagcccgagcgcgccccgacttcgagaaacgtcgcatagtcgcccaggtggtccatgtgcaggtgggtcaggaacacggctcgcacattggccaggaaggtggtcagatcgccctggatgcgctcccggccgcgccggacgtacctgccccggttgaaggcctgggccaggcgacgggtcgcgccgaagccgagatcgataacgtaaagcgcgtcgcccacggccaaggcctgggaggcgctggcccggtcgcagtccggccaccaggtcatgccgccggtggtgccaagcagcgtcagcacggtgttgtggttggccgcccggggcaaatggccgcccggatgattggcggacgcccgtgcctgcctggggcggcgcggcaagccggaaccggcgttgcgaatcggacccataccccctccttgcggcgcgccccgggcgtcaccgattgagcggaaccgggaagaaaaaggcgtcgatgcccgggcgcgggggccgcgacggcggcgcgccttccggcacggtttcgatccagttgacgcgcccggccagatgctcccgggaaatcgcctcgtgaaacgcggcctgaccggctccgggctggccttcccggctggcccagagcagttcgaaatagtgcttgtacgcggtaaacaactgccgggcctgggcgttatttccgctccacagcccgctgccgggccgggcggccacgatggtcccggcctgccagagccggccgctgccaaggcccggggtgtcgaggttggacgaggagacgtaaatgcgccggccggtctcgtggccgggcacgtcgagaagcacgaacttgttgtgcatgtcccggggcgtgccgggattgaccggccggccggccgcgtcgaggctgggccagaccagggccgattcgagggtgaaggccttgcccgtggctgcatcgacacggcgcagcaccgacgggccggcaaggagcgtggccgtggccgttggcgcggccggatcgccgccctgaaactgccacagcaggcgtacggtcaggttgccgggccgcacggccgggacgggatcgtttcgcgtccggtcctccccgcgccggccggcaaaaccctcggccacgaaacggtagaggttgtcgatgaaagaggccgtggggccgatctcgaacatggccacgtccaggaccacgtcacggccctggcgcagttcggcggccgcgtcgaagagagcggcgtcgtaccagtcgatcacccccggggcgtgttgcccgggaaagggagcgttgagatagagcggccagggcttgccggcctgggccggaaagccgcccacaaaggccttggcccggccgccgtagaagcgcaccacgtaatcgcccacggcaaagggcggcaggtcgtcgccgctggagtcggccgtgccccgcccgcccgggaacaggccggtcccgtcgccggttccggccgcctcggccagggcggcgaaagcggcggagaggttcggggcgtcctcgacgaaacgcagggcgttgttgcccttgcaagtgagtcccacggtctggagattgagggagccgtggacggtgtaatattcgccggccccgtcgtcgcactgaaacaccttggcgtgggtttcgggattgccccagcggccgtgttgacggccctcctcgatgcgcgccatggctcccgttcgcggcaacagcgcccgcaggacctcgggcgagacgttgcccacgccgtagcgcacggtgagcgcgcctacgcggtccagggcgtcgatgcgggccagaacctcccgggtcacgtcgtcagcggccgtgcggcgcacgtccttgataagctcgcccccggccggcgtggccacttcgcagaaataatccacattgcaaaagcccatgtggatgttgacggcatagcgcccaggctggccgccaaaccgggccaggggccaaatccagggattgtagcgcgcgtcgttgggcaaaaaggcggccgcgtccgggccggccgccccggcgaaaacgggcaaggcggccgccaacagccccagggccagaaggcggagggcggcgcggcatgcaaatgggagcatgtttcctccgtacgccaagtgaggcgcagccaaacgcgggccgtttcctcggcgtcaacggaccacatctcccctctacccaagccgggcaaaaaagccagccctccccacggccagcgcattggccagacgctgccccgcccggccggcagccccgtccagacgtgccccgtcgccaaaacaggaaaaattctgtagcccaagggcaaatggtcacggcccccagccgtaacgccagccgccctgcccctaacccggcaaacgccaagccagcccggtgccgggcgtctgggccgctcgcgcctccagttgcccggcaatccggccgcacgacagccaaggagccctcatgtccgcacgccccatgccgccgatgggcgcccactccgccagtcgacctgggcacgcccgtggacagcttgcgctttgggcgctgctggcctgcctgctgttcggcctgctgactctggcccggcctgccgccgccggcatcctggccgaagcttcgtgcccatgcggctaccatgtggagcggttgcccctgttcggcggcttcgccaactttcgcaccgtctgcctgttcccggctctttgccgggataaaggcagcctcgtgctcatcaatctgcttgatccggggacgcgtccggcttcctgccccaccggccccctcgcctcactggccgatccggccctcgccccggtcgatggcgaatccgtggccgagtggcggctcgcggacaacaaggtaatacgactccttggcggcggttatccctgcccgcgttgcggccaaatgaccttgcattttcgacagaccgacttttgggactaaaccccggccgcgtgcctcgaacgctccggctccggcgctccatgggattgcggcccaaaaaaccgggaccaacgtatccccaggccggcccctcgcggcgaacttgagcttgtcggccttgccaaagtcccctcaacacaaacggccccgccgaagttgtcggcgaggccgtcgcggcgtccggccaccgggtccggcttactgctccttgagcgaggcaataagcgcgcgcagctcctgggcctgctcggccagttcgacaacggcccgggccgagtggctcatggcgtcggaaacctcggtggaaatgcgattgatgtcgtccacactgcggttgatctcttcgctggccgccgactgctcctcggcggcggtggcgatggaacggacctgatcggtggcgtcctccaccagggccacgatctccttgagcgccgcgcccgagaccccggcctgttcggtggcttggccgatgagcttggcggcggcctcgaaattgtcgacgtttttctgagtgccctgctggatgccggtgatggccgcgcccacctcgcgggtggcggccatggttttttcggccagcttgcgcacctcgtcggcgaccacggcgaacccccgcccggcctcgccggcccgggccgcctcgatggcggcgttgagcgcgagcaggttggtctgatcggcgatgtcgttgatggttgtcatgatctggctgatgtcgccggcctgcctgcccagggcgtgcatgtcccggctgagttcggaagccttgtcgcgcaccatgcctatgctggccacggcctcgtccaccaccccggccccctgctcggccttgcgtttggcgtcgtggacggtctcggcggcccggccggcgtttcgggccacttccaggacggtggcgttcatctcttccatggccgtggccgtttcggccgtgcgccgggcctgttcctgggcgccatggttggattcttccacctgggacgagagttcttccgaggccgaggacaccacggccaccacgccttcgagacgacctgcggcggccaacatgccctcgcgcttggcctgttcggcccggctccgggcctcgtcggcccgggccgtggcttgccgggcgatctcggtctgttcctcggcctcccgggtcttggccgtggccgtctcgatcatggcccgcagcttgaccgccatggcgtccagggaatcggacaaggcccccagttcgtcgcgccgggccagggacaacgtgcgcccgagctcgccctcggccaccgcgccggcaaaggacacgcaccgggccaggtcggccacgatcttgcgggtgatccagacaataagaatgcacacgaccagggtgcccgcgccgccgaaaagcagggtggtgtcgcgcacggcctggctggagcgggcgatgtcgtcggcgttgacggtgacggccacggtccagccggtgttcttgtcgcgggcgaagacggcggccttggtcaggccgtcgagctgatattcgaccacaccacgggtcatggacaggagtttacggccccagtcgaactcggccagcttgaatttgaggatgcgttcggcattagggtggctgaagaccacgccggccttgtccgcgatgtaggcgtagccgttttggcccaccttgaccggggcaaccatgtcctcggaaaatttggccaggttgacccgcacgaccaaaaccccggtcggccggccgccgacggccacgggcgtggccaccagaaacaccggcttgcccgtggaacggctcagcagcggttcggaataattggtctcgcccttgatcgcctgctgaaaatagccacggtcggcgtagctgccggccactccggagtcggtggacaacagcacgccgcccttgtcgtcgagaataaagccggcatcgatggaactgtcaaaggccagcaactccttgagggcggccagggccttttgctgcacggccccgtccttggccgaggcggcaacatatcccgtgacggactcgctgcggctctgcaggacaagcatacttttgatgtcttccgtgtagatgctcaggcccttgcacacggtatcggcaatatgctgcgaagaggaaatgagctcattccagagttcatctgaagctttgcgataggaaaaaagtccggccatggccatactggccacgatagacaaaatggtcggcaacaacagcttcgattgcaatcccagtcgcatatttcacctgtgcttgttgtgcaacaatcccacctgatgaccatcaatcacacactgccatattgcgtacagtatttttcaaaaacggacaacggcacaacactttttttcaatagatttcatggcaatcgtttacaagaaaacaatatgaattcctccaagttggaacaatcttgctcacctatctcccccgcaacgccccgaggacgttcgcccttccccaagctccagccacgtgggagcgacaccggcgacgattccccaaacggcccgcgagaaaaacggccccaggccaaaacaattggcgatcctggcaatttcgcgccagccagcgacgcttacaggcgggccgccaagtcgtgtgtttcccttttatgatttgacgcctagcgctattcacggcaaatagtttatggaaagctccattcacgccatccaaaggttctccatgatgccgacgcttcgccgattgaccattttgtccgtctgcctgctcttgccactggccacggccttcgtcagcgtgcaagcggcgcggtccatcattttcgacgaacatcgtcacgccctgcaagagtcggccaaacgcctgcatttcgccctggtcgacaagaccatcgacagccagctcatcggcgcgaccagcctgctcggcctgatccagcccaccgtgaagctcgccgttcgcggcacgccgctcaccgaaagcgaccgtagcgaactgcacaacgtccttgaccccctgcgccgccaatacgcggccgaagggacctatctcatcgaagctggcggcgtcatccgcatccacgacaccgagggatccacctccgaaggactcaacgtcgcctttcggccttacttccggcaggccatggccggccggcccaacatctacgccgccgtgggcaaacagtcccaggagcgcggcctctactacgccgcgccggtgcgcgacggcgcgctgcccacctccccggtcatcggcgtcatcatgaccaagattggcgcggcgtttctcgacgccctcctggccggctccggcagccaggccgtgctgctctcgcccgaaggcgtggcgtttgccgccacgcgccccgagtggctttacgccgtggcccctgcggccacggaaggcaaacctgccgccatggaccgcgccagccgcttcggcgacgtgttcaagggccgccaggcggctacgcttcccttctcgcccgaccaggacaccgctgacatcgccggcgccgcctggagccttgccacccagtccgtggactgggacgatcccgaaggaaactggaccctggtggtgctccaggataccgccacgtggttccccccggccaagcgcctgctgacggccggcctgaccgccgccggaacgctgctggtctgtctgacgctggtggccctggaccgggtgcgccaacgccgggccagggcggcggcccggtttcgcacccttggcgtggccatggaagtcagccccctggccgtggtcgtcaccgaccgcaaaacccgcatccgttgggtcaacccccagttcgagcgggtgacccagtacagcctggccgaggtcaaacggcgcgatcccaacgtcctggccagcggcgcgaccccccgggaagtctacgacgagatgcgccgctcccttcgcgccggccaaccctggagcggcgaattcgtcaaccggcgcaaggacggctcccattaccatgcccgggtggccatctcgccggtaaacgacgacaagggcaacctccttggctacgtgggtttgcaggaggacgtcagcgaatacaagcgtctgctgtcgcggatggaatcccagctgcgcctggaggcgggactcacacatttcgccgcgtcgtttaaaaacgaattcgaccccgaccggctggcggctttggccctgaacgagctggtccggtttttgtccctgccctacgccgccgtccatgtccgctgccgcgagtcctccgcccaggtcctggcccgcttcggcggcgacaggccgcccggcgacgacatctccggcgcctgccgccccctggtcgatgacgtcatcgcctcgggccggcccttttccctgcgcgacctgcctgaaacagccagcgtcgccctggccggcggcgcggccgggctgacggaaatccggctgttgcccctgggcgacggccagtcggccgtgggggcactggagatcggcctgttgcgcgaactgtccgaggccgaccagcgctacctggacaaggcccgggccgaactggccctggcgctcaagctcgccttggacatcggcgagcgcgtccgggctcagcaggccctggccgaccagaacgccttccagcaggtgctgctcgacaccatccccaaccccgtcttctacaaaggcgcggacacccgctttctggggttcaaccgggcctacgaggaaaccttcggcgtgcggcgcgaggagcttgtcggcaaacgcgtcctggacctcgactacctgcccgaggcggaccggctggcctaccagcgcgaggacgaggaggccattgccgccggcggttcggtgcgccgggaaatgcgcattccctttgccgacggggccatgcacgagaccctctactacgtttcgggctttcgccgggccgacggcagccccggcggcctggtcggcaccttcgtggacatcagcgagcaaaaagccgtggagcgggccctggccgcggccaaggaagcggccgtggaggccaccctgctcaagtccgatttcctggccaacatgagccacgaaatccgcacccccatgaacgccatcgtgggcctgtcccatctggcgctgaccaccgagctgaccccccgccagcgggactacatgggcaagatccagcaggccagccagcatctgctcggcatcatcaacgacatcctggatttctccaaaatcgaggccggcaagctgtccatcgaacgcaccgacttcgacctgtcggcggtgctcgaaaacgtggccgcgctgattcgggaaaaggccgaggccaaggggctggagctgctcttcgacgtggccgccgacgtgccccaggaccttgtgggcgacccgctgcgcctggggcagatcctggtcaactacgccaacaacgccgtcaagttcaccgaagccggcgaggtgggcatccgggtgcggcttatcgccgaagatggcggcgaggcggtcctgcgcttcgaggtgcgcgacaccggcatcgggctgacccaggaacaaatcgcccggttgttccagagcttttcccaggccgacgcctccaccacccgccgctttggcggcacgggcctggggctggccatctccaagcgactggccgaactcatgcgcggcgaagtcggcgtagactcgaccccgggggcgggttcgaccttctggttcacggcgcggctgcgcaaaagccgcaaacgccaccgcgtccttttgcccgacccggacctgcgcggccggcgtgtcctggtggtggacgacaacgaaagcgcccgcacggtgctcaccgacatgctggccgccatgagcttttccgtggaggccgccgcctcgggccaggaggccttaagcgttctggaagcggcccggggcaagaaccagcccttcgaggtcgtgctgctcgactggcagatgcccggcatggacggcctggaaaccgccgagcgaattcgcgccaagtttgatgcgccgccgccccatctggtcatggtcacggcctttggccgcgaggaggtcctgcgcggggccgaggacggcggcttcgaggccgtgctgctcaagcccgtgaccccgtccctgctttttgacaccctcatgcgcgccctgggcggctttcacgaggaacggcggcaggccccggacgcccaggccgggcaagccagccaccccggccagggtcggctgctcgtggtggaggacaacgaggtcaaccagcaggtggcccgggagctgctgacccaggccggctacaccgtggatgtggctgaaaacggcgaggtcgccttggagatggtgcagcgcacgccctacgacctcgtcttcatggacatgcagatgccggtcatggacggtctggccgccaccatcgccatccgcaagctgccgggcttcgccgctctgcccatcgtggccatgaccgccaacgccatgcgccaggaccgggaaaaatgcctggccgccggcatgaacgatttcgtggccaagcccatcgatccccaggccctttttgccgtgttgacggcctggatcgcgccaaaagccggacaggacacggccatcccggcggccccgccaccaccgcccgcccaagccctggacggcatcgacgtcgcggccggcctgggacgggtgggcggcaacgccgccctttacgacaggttgctggaaaagatgggccaggagttcccagccgtgcccgagcgggtccgggaactcctgaccgccggggaccgggcggcggcggagatcgcggcccactccgtcaagggcgcggccggcaacgtgggggccgacgagctggccggcgcggccggcgagctggaaaaggctctgcgccacggcgacgacgaggcggcccgggcggccctgccggcctttgcccaggccgtggaccggttcgcccgggccgtggccggccgggacaagcccgaggccccgccccaggcgacgacgccggaaccggcttcgggtaactgcgctgtcgatgtcctggccgccctgggcgaacttctgccccatctggaagcccgaaagcccaagccctgcgccaagatcatggaaaccctgcgggacacgccctgcggcgaggctgtgcggacggacatcacggccctggaagccctcatccgaagctacaaatttccccaagccctagaactcgcgcgcgccctgctggccgccaaggcctcggagactgcatgaaaaccctggctgagtgcctgatcctgctggtggacgacacggaaaccaacctggacatcctggtggacgccctgggcgaggaccacgaggtggcggtggccaccgacggccccacggccctggccctggccaaggaacaaacgcccgacctgattctgctcgacatcatgatgcccggcatggacggctacgaagtctgccgccggctcatggccgatccggccacggcggagacgcccgtcatcttcctcacggcgctcaccgatgtggccgacaagacgcgcggatttgccgtcggcggcgtggactacgtgaccaagccctttgagccggcggaaatcaaggcccgggcgcgcacccatctgtccctgcgcctggcccgccaggagctggcccggcaaaacgagatcctggaagaaaaagtccgggaacgcacccgggaactggccctgacccaggacgccatcatcgaggccatggccgggctggccgaataccgcgacccggaaaccggcgcgcacatcaagcgtacccgcaactatgtgcgtgtgttggccgagaaactgcgcgcacagcccggatacgacggctatttcacggacgagattattgatctgctttataagtccgcgccgctgcacgacatcggcaaggtcggcgtgcgcgacgacatcctgctcaagcccggccccctgaccgacgccgaattcgcggtcatgcgccgccacaccgtctacggccgcgacgccatccaggccgccgccaagaatctcggcgacaattccttcctgcgtctggcccaggagatcgcctacacccaccaggaacgctgggacggcaccggctatccccaggggctggccggtgaggccatccccattcccggccggctcatggccatcgccgacgtctacgacgcgctcattagccggcgcgtctacaaagcgcccttcacccacgcccaggccgtggccgtcatccgcgacggccggggcaaccatttcgatccgtccatggtcgacgccttcctggacgttcaagaaaccttcaggcagattgccctcaaatttaccgaaagcgacgaagaacgccaggcgctggagcacccctatgtggcctgattgcgacaagacggtgatcgacatggtacgcgacgccaaacaaaccatcctcatcgtggacgacgtggaaaccgacgtcgacaccctggtcgaaaccctcggcgacgactacgagatcgccgtggccctggacggccccacggccctgcaaagcctggcccccaacccgcccgacctcatcctcctcgacatcctcatgcctggcatggacggccacgaggtctgccgccgcctcaaagccgacccggccaccgccgccattcccgtcatcttcctgaccgccctgaccgaggtgcgcgagaaggtcacgggcttcgccctgggcgcggtggattacatcaccaaacccttcgacatccaggaggtcaaggcccgggtcacgacccatctggcgctcaaggcagccatggagcagctggcccgccagaacacgcttctggccgaggcggcgcgcctgcgcgaggacgtggagcgcatcacccaccacgacctcaaggggccgcttggcgtcatcctgtccctgccccagctcatcgccgccggcggcaacctgaccggggagcagaccggctacctggaagacatcgaggaagccggctaccagatgctcaacatggtcaacctgtccctgggcctgctcaagatggagcaaggggtttacgaattgtcccccaggccggtggacatcgtgcgggtcattggcaaggtcgtggaggagctggcgtccctgcgccgcgcccggggcgtgtccgtggaactgcgccagcagggtgctcccctggaaccgggcgtcgctgtggacgtcgttggcgaagagcttttatgccactccatgctctccaacctgctcaaaaacgccatcgagcattccccggccggcggccgggtggacatcgacatcgccccggccaaagacggcctgcgcgccctgcgcctgcgcaacctcggcgaaaccgaccccggtttccgggagcggtttttcgagaaatacgccacccacggcaagcccggcggcaccggccttggcacctattcggcccggctcatggcccggaccatgggcggcgaggtgctgctcgacgcggccacgcccggggaaaccaacctcgtgctgtgcctgcccgcgccggcctgattcccgccgcaacaagtctcatcccgccccggacagccgcatccggggcgacttcagggtgggcacgtccgaggacgacgccccgccaggacagccgcaacggcgaagccgccacgcctttgatcccctttcttccgactttatcgtccccgcgatagtcccccggccccggtcgggctagtgagcgccatccccgccgcaaggcgattaccggaggcgccgtatggccaacgagtccgtcgcgaccgtcaacgaatgccggggaggtttcggaacctacatctccgagaacctctccctgtgcgggcgaagcccccgcgtcacctgggccggttatgccgccgcctgggccgccttcgccgccgtcaactacctcttgcccctgccggaaggcctgtcccgcgagggcatgtcggtgctggccatcctcatctgggcctcgatcatgtgggtctcggaagccatgcccgtgggcatcaccggcatctccatccccaccctgctcgtgctgacccgcgccctgccctggaccaacggcaagccgcccatgggccaggtcttctcggggttcaccacccacgaagtctggctgtgcctgttcgcctttttcaccggagccatcatccagcttttgggcatggacaagcgcatcgccctggccatcttggacaagatcaaggcctcaagcgtcgggcgcatcatctggggcatgttcggggtcaacctggccctggccttcctcatcccggccgccaacgcccgggccgccaccatcatgcccgtggtccagggcatcaccgcccttttgggcgacaccccccgggagcgcgaggccaaaaaggccatcgttatccaggccatggtctacgccagcatgatctccggcctttttatcctcaccggccacatgcccaacctcatcatgaccggccttttcgagaaaaacggctttaaaaacctcggctacttcaactggatgctcctgcacctcccctacctgctgctgtttgccgtcagccaatggtgggtgcgcttccatttcaagaccgacggcgtggccattgccggcggccatgagcagatccaccgccagtacaaagcccttggccccgcgagccgggccgagaaggccatgctggccgtgttcgccctggtcggcgtgctgttcatgaccggcaacggcagcccgctggtgctccacaaccaccagctcggcgtcatcggcctggtcggcatcatgctccttttcatcccgggcctttttcccttcaagtggaaggccgtgcaggaccgcaccatctggggcaccttcctgcttctgggcggggccatcaccatgaccgacgccatgaccaagtccggcctggccggttggaccgccgagcacatccacggcctggtccagggcatgggctggtggcagaccgtggctgtcatgatgctgggcacccagatcctgcgcctgggcatgctctccaacgtggccgccgtggccatgctggcccccatcgtcttcgccatgggccccaagctcgggctgcatcccgtggccttcaccctgctcatctgcaacgtggacaccttcgcctacctgctgcccacccagatcacggcggcggtcatcgcctacggtaccggaaccttttccaccgccgactacgccaaggccggctgggtctgcaccctgctcgccatagccttcggcatcgccgtcatggccccctggtacgcgtttttcggcctgcccgtctggaacccggccgccccctggccctattagccccgtccgtccccatcgacgacaaggagtacgacaatgcctcgcatggcccccaatccccccagtcttgacgccgtggaaaccgtctgcgtggactgcgatgtcctcatcatcggcggcggcaacgccggctgcttctcggccgtggaagcggccaagctcgaccccaccctcaaggtggtcatcatggaaaaggcccacatcatgcgctccggtgcctgctctgccggcatggacgccatcaacacctacatccccgaaggcaagaccccggaagacctggtgcgctggtgccgctcccaggtcggcggcggccccatccgcgaggatctggccctgtccaacgcccgggaactcaacgagtccgtggacgacctggagcgctggggcctgcccatcctgcgcgacgaaaatggcaacatccgctaccggggagcctgggacatctccatccacggcgagcagttaaagcccatcatggccgagaaggccatcgaggccggggccgaggtgtataaccgcgtagcctgcacccagctcctcatggacggcaaccgctgcatcggggccctgggctttggcgtgcgcgacggcaagttctacgtgtttcgggccaaggccaccatcaacgccaccggcggcgcggccggcctgtataaaagctacaccgccgacgccaccgacgcccaccaccagatctggatgtgcccctactgcgtgggcacgggctatgccgtgggcatccgccagggcgcggaaatgacctccatggagcagcgctgggtggccacccgcaccaaggacttctgcggtccggtggacaccatctcggtgggctacaaggccccgatcatcaacgccaagggcgagcgcatcatgcaaagccgctacgcccacctgggcgcggacaaggccccccgctacatccgggccaacgcgcccatggaagagtggctggccgggcgcggccccacctactgcgacacgcgcggcatggccccggaactggctcagcagatgatgacggattatttgaacgagcgtccgagcttcgtgctcttcctggccagccggggccaggacccggtcaaggaacccatcgagatctacggctccgacccctacatcgtcggcggccacacccagtcgggcttttgggtcgacatggagcgcatgaccaccatcccgggcctgttcgcggccggcgagacggccggcggcaaccccaacaagttcgtgggcggctgcgccgccgagggcaagctggccctgcgcggcgcggcggcctacatcgcgggcctggaactgcccgagcccgacgccgcccaggtagacgccgaaaaagcccgggtgttcgccccgcttttgcgcggcgaggccttcgacggtctgcgcgccctggagatggaagagcgcctgcagcggcttatggacgaatacgccggcggcaccagccagttctaccgcaccaacgaagagcgcctggactatgcgctcaagcacctggccatgctgcgcagccaggtccagtacctcaaagccggggatctccacgacctcatggccgtgcacgaggtcatcgaccgcatcgacgtggccgaggtgctgtgccaccacctgcgcttccgcaaggagacccgctggcagggctggcagacccgttcggactatcccgaggtcgatccggcctacgactgccatgtggaaagccgcaagaacctggccaccggcgagatcgagaccttcacccgcccctacgagcaaatcgttgcgggcgaccgctacaagccctaacaggaggacgccatgccgcccatcgtcgaccccaagaagtgcaacggctgcgccggccgcgaggaatcgttctgcgaagaagcctgcccgggcgatctcatgtacgtgggccaggacggaaaatcccattgccacgccgcgcgcgactgctgggactgcatgtcctgcgtcaagatgtgcccgagaaacgccatcgaaacgcgcatgccctaccagctcggctaccacaaggcccggctcgtgccgctgatgggcaagaacgccatcacctggaagtgcacggacatcaacggcaacaccgtgacctacaagtaccgcaaccgcctggacgtcaaggactagcgccgcgccggccaacgccccgttttcggacggggcgttggccttctgccttgacccggcgaataaggaccctattttagcccatggccaagtgtgaacaccccaggcaatggcacctgctaaagggcggcttcttcgacggcctggaacgcgagttcgaggcctttcggaggttggccacggtgcggcgcgtcaagaaaaacgccatcgtattttttgaaaacgaccgatgcgaccgctccttttacctggaccaggggtcggtcaagatcttccgggtgtcgctgcacggcaaggagccgacctttttcatccgctcggccggcgagatgttcggcctggccgaggtggtgggcggcgagcggcgcaagtgctcggcccaggccctgtccgaatgcctgctgttggacatccgccgcgatgacctgctggggcttttggtggagcagccgttcatggcccggcgcatcatcgaggtgcttggccggcgcatccgctacttaagcgaccagctcgaaaacgtcatgacctgcgacgtgccgaccaggcttttaaagctcttgctctgcctgtcccacgacgagatcgcccaggcccggggcggtccggccgacgtgccggtgcgcctgacccaggggcagatcgcggccatgactggttcctgccagcagaccatcagtgaaaccctggccgccttcgaaagccgtggacttatcgccgtctcccgccagcgcatccgcctgctcgatcccggggccatcctggacgccctgtccggcggcgacggcggggccgaaggccaataagccgtcctggcatcactttttctcaatcaatcctcacaggacgatgcgacgcttttcatgatgcggtcgctcttcttttgcgtcattgccccaaaaccggagcaacgcctttcccgccctcagccgggagtgtccagggacgggacggtcgcctttgaccggtgttaaactaacggaaggctcatcgcggcatggggcctgatggagcaaaacaaggcaatacgagtccatgcctcctcctttccaaatcgtctccccaatcccggttctccatcggcaacggcctatccccgcacagtgtcgatggacgccccccaaaaagcgttttatgatcatcgcaaggcccacttgccagaacgtctcttcggcccatggccgatgcgccggatacgggaggcgcgacatggacaaaaaacgcatctcgtcggaatggatcggacaggcagccaaggccaccggctgggaggccgcgctgtctcgccggggatttctcaagctgtccggctgcgcgcttgccggcctggccttcctgaaccttggcgaggcctacggcgaaaacacgccgttggtgatcctggagagcgcccagggcgtgctgctggccgatcccacccgctgcgtggcctgcgggcggtgcgagctggcctgcacggaatttaacgacggccgggcccagccgtcgttggcccgcatcaagatcgcccgcaccgtcaatttcggccccaccggccccaccggcggccaggccatgcacggggactggggcgacgggctggtgatccagggcgtgtgccgccagtgcccccatcccgtgccctgcgccacggcctgtccccaaaacgccatcgtcgccgacccccaaaccggggctcgggtggtcgacgccgcccagtgcgtgggctgccgcctgtgccagcaggcctgcccctggggcatgatcgcctttgacgagcaggccggggtggccgccaaatgcaccctgtgccagggccgccccaaatgcgtggaagcctgtccggcggcggccctgcgctacgtgccctggcgcgacctcacccgcgacggcgcgccgacccggcccaccctgtccgtcgtcccacccgaaacggccaagacctgcctggactgccatgccccggccggcacgaggccggcgaaatagcctcttctgtaagacacaacgtccgtggtgttttaacaatacagattacagcagtatgctgtgcctcatgaagctgcgctttagaggtggaatcgcaatcccccttcatcgggaaggagctcgtcatggccgtaggcagcggtggatttgtcggcaaggtcctgcgcgtcgatctctccaccggcaagatcaccaccgaggagacccgcgaacgctacacggccctgctcggcggggccggcatcggctaccgggtgctctgggacgaggttccggccgggaccggcccctttgacgcggccaacaagctcgttttcgccaccggtccccttgtcggcacgagcgtgccgtgcaacggccgcgccaccatcaccacgctttttcccacctgctggcccaagccgctggtcggctcggggcacatgggcgggcacttcgcggccaagctcaaatacgccggctttgatgccctgatcgtggaaggcaaggccgacaagcccgtctggctcatgatccgcgacgcccgggtggagatccgcgacgcccggcacttgtggggttcgggcatccgccgggccacgttggaaatcagccaggaaatggggccggactgcgtggtggcggccatcggccaggccggggagaatctggctcccatgggcatggtgatcaattccgtttcccattcggccggcggcgtgggcggcattatgggcggcaagaacctcaaggccgtggccgtgcagggcagcggcgcggtgcgcatcgccggggacaaggccgcctgggaggccctggtcaagttccatctctccatcatgggcgccaacaaccagcacgtggtgccgagcttccccacgccccaggccgaatactacaatccggcctcccgctgggtcggccagcccggcaagcactggggcgcggccaagcctcccgtggaacttcccggcgatattcatgacccgggcagcatcgcctttcgcaccaacagcgccgcctatttcctgggcgacgaggcctggaaatacaccgtgcgcggcaacggctgcacggcctgccccatccgctgccacaccatgctcaagatgccgtcggtgaccgccaagtacggcatcccggacatgggccagaacacctgcgtggcgctgatgttcggccgctcgtttttcaagcagctggctggcaagaaaaacagcgaggccgccatggaggcctgcatggtgggcatgcatctggccgacgacctgggcttgtggtccaactacggccagttgcaacgcgacctgcgaaagctctacgaaggcggctatctgaaggccaggcttgggtccaaggaatacgcatccatcccctgggacaagtacgagagcgccgatccggccttcctgctggacctcatcccccgcgtcgccaaccgccagggcgaactcggggacgtgctcagtcgcggcacgggtgcgatcttcgaccactggtccatcccggagtcggagtgggccgaggaccactcgacgacctactggaagatgggccatgccaagcaccacgccaacgaggacgacggccagtgcggcgtgatcatcaacacccagtacaaccgcgacgcccagtgccactcccatacgaacttcgtgcgaaacggcctgcccctggaggtgcagaagaaactggccgccgccatctggggttcgcccgacgccctggacgccccaggggactacacgccggccaacatccacaaagcccatcgggccaagtggtcgcttctgcgcaaggaactccacgacgccctgggggtctgcaactggatggggccgtgggcggcctctcccttgcgcgagcgcggctatgccggggacgacagcctggagtcgaagtttttgagcctggccaccggccaggccatggaccgggaggagctggaccgggtggcggagcgcatcttcaccctgcaccgggccctgaccattcgggacatggggcgggtggacatgcgcgccgcccacgacatcgtgccgccctgggtcttcgaggacccaaacggcgcggcggccttgaccaagggcaccatccgcatggacccggccgacatcgccaaggccatggactattattacgaggccatgggctgggacaaggccacgggcgcgccgagccaggcacgctacgccgcactgggcctggccgacgtgggcgaagccctggccgccgctaagctcacgcccgaggccgcgaagtgagcgcggccggcgaagccgacgcgcccgggcggaacgatgcggccgagctggctgggctgaacgatccagccgggctggccgatccggccgacctgaccaccctggccgggctatccgaaccatccaggctgcctgagcagatcgggctgtccgaaccggccaccgaagccgaactggcccgggctgttctggagaccatccgggaagccagcgccgagcctcggctgctcgccttggaagaaatcctggaggggctgcgggagcgtggcctggccgaacgcctggaaacttcgccgccagacgatccaggcacggcgctggccgtcatcgtcgcggacctgcccgaaatcgcgtccttgaccagccggtccggccggaccctctaccacgacccggccctgctcagtcacagctacgcccgcctgctggacaaccaggacgtgcccgaggagcttctggccgaggctgtccggtcaaattcccgggactacccgcgccccgtgccggtcgaactcttcgagaagccgcccttcgatctcgcctcgtctgacgtcgccgccatcctcgacgccatggccgccaagccgcaatttcaggacatcgcgaccatccagacgtccacaggaacggcctatctgttttcgagcctctatctggcccgcgcctatgcggccttcctggcggaacaggaaacaacgctggccatgaacccgtgatccgccgcctgacggcggaggctgccaggcaaaagcccagggtctgggccgtgcccttgcggcgcgcctgaggccgagccgggcttacgccccgaacttcatgccggcatcaagagccagtccgatgcccacgctgccaaaccggctcccctccaccaggcgggcagcgggcacggcctggcgacaggcctgggcgatgcgcgggatggccgtgctgccgcctgtcatgaacagcgtctgtatggccgaggccggaacgccggcaaggctgaggcattcgtctattttcgacacaatgcttgctgtttcaggcgcgatgtcggactcgaattcctggcgacgcagggaagcttccagccctttctccacgtagctcaaggcaatcgaggcggcatcctgctgcgaaagcgcgattttcgcggcttcgacatccccggccaggcgatggccttcctggcgctcaatgatcctgaccagcctgtcgaccagatcttggcgctgggcatggtacttgatgttcttgaccccttgcaacgctctgttgttatacagaaaaacgatcttgtgccaggtcgccagttcgcgatagtacgtcggcggcaagtccagaatgggatcgccgggaaaaaggctcctggtccgcgtcctgtagccgaaaagcggcatcacctgctcaaggctcagtttcaggtccagatcggtgccgccgacatgcacgcccgtgttggccaggatgtcctgcttgcggtcggccttgccccgcctgtccggcgacaccctgacgatggaaaaatccgatgttccgccgccgatatcgactatgagggcgagttcttcctgctggacagactgctcataatccaaggcagccgcgatgggttcgtactggaagagcacctcgcgaaaaccggctttcctggcgatctcctccagatgcgcctgggccagggcgtcggcctgctcgtcggcgtccacaaaccggacaggcctgcccatgacgacgctgtccacggcatggccgacagcggtttccgcgccaatcttcaaatgccgcacgaacgtgacaatgatgtccttgaaggcaatgttcttatagcccacttccgtggattcgttgaccagcgagctgcccagtatgcttttgagcgaacgcagcaaccggccttcgcagccgtccatgtaaaaggctatcgctgcattgccaaagagcacggcatcttcttccgtgtcataaaaaatggcgctggggatcgtctgtttcccgtcctccaacgcgacgaggcaaggcaatccgtccttcaacaaaccaacagcggaatttgatgtcccgaagtcaatgccaagagccacagactcaccttctccgtaaacgtttcgggccgacagctgcccaagacagccccgccccatgcccgtcagaccgacaacaaaacaagaccccgttggcctttcgccaaaaggatcatttttgatgatatttcgtgggatcgctttatgtgacgaggtcatgcccgtggcctgtcaagcacacggccccgccttgaacgacaactcggcaaacagcttccgaacaaaaaaatttgcaccaaacgccttgagaagtcaaacgcccgaacgccattccccaaaacgcgctggccaccgcccgccatgcgccagacggaccttgaagacgcggcccgaggtggcggtctctgattgataacgtaccgtttttatgtgacagtcaacgcagcaggcgacaggtcgtattgcaaatcgccagatggactttgaaaatcgaccgccagggaagtgcccatgtcaaaagtgctgcatcttgtgcttcttgccgccctgctcgcccttgtcgcgccttgttcggccgacgccgcaggggccttcaatcagtttgtcggcctgggcgacagcaccctggacagcggctattttcgctatgcatcgacaggcaacgcctcggcggacgccatggtcgccgccgccgtcgccggcggagcccagggcggatgggccggccccgggatcatgacctccacgtttctggccggccggttcggcctttccgccgagccggtcagcatcggcggcaccaacttcggcaacggcagcgcctacacggcccccttgagcgccacggccggcggtgtcacggctcccggaaacctgcccggcaacgtgaccgccaccgagcagatcgcctgcctcctggccgccaacgggggcgccgccaacacccaggcgctctatgtcgtcaacagcggcaacaacgatctgatcttcgtgcaaaaacagggagccgactggatcgccgccaatccgaccttcttaaacggcgtggcggcccagttcacggccagcgtggccagcttgcaggcggccggagcgcgcaccgtcatggtgcccaacaccttttacacctcgaccctgaccggcctgggcggcctcgtcccggccagcaacgtcgacgactacgcccgcgccgtggcctacgggaacaccaagtggtcgtacctgacaacggccggcgtgcggtacatccccgccgacctcaccagcctgttccagttcgtggccaccaatcccacgctgttcgggttcacgccgtcctcggtgctggcgtccaacgccccgtccccggtggccgccctggtgaccacctgggccgacatcacgcccatccagttgcaaacgtatctgttcatcgacggccaccacctgaccacggccggccagaagatcgagtcggattatgagacaagcctgctcacggccccgagcctgatgtccctgctggccgaactccccatccagggcggcctgacccggacggccgtcctccagggtcagatcgacctgaccgggcagcatcgcggccaagcacgcgtcaacgtctggatgggcggcggcgtcggcgcgctgacgcttcgaaacttctccggctttcccgatgtcgccggcacgccgtttaccggctcggcgggcctggactatcagctgccctgcggcctcatcgtcggcgcggcctttaccgccgggacccagacccagcagttttccatgggcggcgggcacttcgaccagaacgaccagacactcagcctctattccgcctatcaggccggaccggtctggggcgatgtcgtggcctcctacggcttcctccaggacaagatcgcccgggacgttgccctggggcttttcaccgacagcaacagcgccacgaccacgggaacgtccctgggcctggcccttcgcgccggcggcgacatccgcctggggccggtggtcaccggtccggtggccgggctggtgctgcagcaggtgcgcataaagggttttgccgaatccgggaccagcggcgcggccaccggcggcaacggcgtcacggccctgtcctttggccagcagatacgcgattcggccataagccagctcggctggcgcgccgccatcgaggcgggctcctggcggccgttcgtggaagccaaatggcaccacgaactggtggaccaggccgaccgcaaggtcaaggccgccctgaccacgaccacggcccagccctattccatggccgccgccccggtgaaagccgattgggccacggccagcctggggacttcctataaaatcaatgagcgggtgatggtgcgcggcgcggcttcagccatggcctttgacgcccaaaccgtcagctacggcggcgacctgggattgagcgtcagtttttaagctcccggcctaccccgccgcccccacccccggcgtatcgggttttcggccgtcggcgaccgggcatcccaatggaggaagagcatgattcgatcatggcctgcgcggcgaaacagcgtttctttcctgcggccggattgcctgatcatcctggccctgtgctgtctgttgctggtcgccacggccgccctggcccagaccgaccccctgcccgcctggaacgaggggccggccaaacaggcgatcctggccttcgtgcgcgcgaccaccgacccgtcgaacccgagctatgtccggcccgaggcgcgcatcgccacctttgaccaggacggcacgacctgggtcgagcagcccatgtacacgcccatgctctactgtctggcccggctgcgcgagctggccaaggacaagccggagctggccggggccgaacccttcaagtccctgctgtccggcggtctggagcgcctggccgacgcgtccaccgacgacatcgtcaagctctacgccgcgaccatgaccggcatgaccgtggaggaactcggcaaccaggtgcgccggtggctggatacggcccgggatgcccgctgggggcggccctacaccgagcttgtctaccagcccatgctggaagtgatgcaactccttcgcgcccacggctataagacctatttcgtcaccggcggcggccaggattttctgcgcgcctacgccgaaaaggtctacggcgtgccgcccgaacaggtggtgggcacgctcaacgccacgaaattcggctatgacgccgccggcaaggcgatcctgaccgaagagccaaagctgttgctcaataacgtcggcccgggcaaaccccagggcatccacctcatgatcggccgccatccccaggcggcctttggcaattccgacggggacaaggaaatgctcgaatacgcccaggccggcggcggcgcgcggctgatgatgctcgtgcgccatgacgacgccgagcgggaatacgcctacgccgcccagtccaagatcgggacgttccccgactccctgctggccgaagcggcccaaaaaggttgggtcgtcatcagcatgaaacaggattggaagcgtattttttcttgggagtagcgggcagcccacggccgtttcccctttctccctgcccgttttgacaccgcgaaacgacaaacaatacgagctaaaaccaacggggttaccgagaaatcggcaaccccgtttgcttgtgaaaaagcacaagcgccaacacgaggggagggcttgccccacgctcccacccggagccatccacttttttattgacatgaaaaatgataaaaactaaaaatcatcattaaattttattgcagcacttagggccttccatctcccccaaggctgacccaatagaggacaacaccatgggccgaaaaaaaaccaccgcctccgacgcggcggccatcaaactgcagatcatcgagaccgccgaaaatctctttcgtcaggtcggctacgccaagaccaccgtcaccgacatcgccaaggcgctggggatgagccaggccaacatctaccgctattttccctccaaagcggccatcaatgaggctatctgcgaccggctggtgcatcagatcgaagcgcaatgctgggaatccttggtgcaggacggcacgtccaccgaacgcctgaagcgcttcatcaaggaatatcaccgcacggtcaaaaacagcatcatcaaggaaaagcggttgtacgacatggtggccgtagccatggacgagcattggtccgtcatccagggccacagtgaccgcatcaaggatttattcaaaatcatcatcgagcagggcatgtcgtcgggcgaattccggcgcgtccacagcaacaccatggccaaggccctgcatggttccctggcggtcttcatctatccctcgctgctcgaacacgagatcaacgacgaggacaacgacaacggacaggatcgcctcgacgccgatcttgaccaactccttgatctactcttgcacggcctctgctcgggcgaaaaataggttttcgccggcaacccgccatcaggatggttttatcatgtccatggaacaccccttcgctttggcgaaacacgtcacacggcagtgccgggcacggcttttcctggcggccctgtgtctgggccttgccggttgccacgaagccgcgccaagtccccctttccggccggtggtcaacaccatgcgcgtcaccctggacacggccacggccaggcgcacctaccccggcgtggtcgtagcccgccacgaggtgcaggaatccttccgggttggcggacgcatcgaaaagcggctggtggacgtcggcgaccatgtccgggaaggccaggtgctggcgactttggacgaaaaggatctgcgcctttcggtggagagcgcccaggccgaactgcgggcggccctgtccaacaaggaccagaccgccagcgacgacaagcgctatgccacgctgctgtccaagcatgtggtcagccagtccgaatacgatctcaagcatctggccgccgacgaggcccgttcgcgggtggagcgcgccgagagcgccctcaagctggccatgagccagctgggctatgcccggctcgtggccagcaccgacggcgtggtcaccaaaaccagcgccgaggccggccaggtcgtgccccaggggcaaagcgtggtcaccctggcccgcaagggcgcgctggaagtgctggtcgacatccccgaacgccggctgcaggacatcaaggacacccaggcggaaatctccctgtgggccaatcatgacgcccgcttccgggccgtgctgcgcgaaacgtccccatcggccgatccggccacccggacctatgccgtgcgctactccctgcccgacgccgacgccgccgtgcgcctgggcatgacggccacgctgcacctctccgaggccgccgccgccccgaccgcccgcatcccggccagcgccctgctcaaccagggcagcggcccgggcgtctggcgcgtcgacgtccaaaccggccagctgaccctggtcccggtcacggtggaccactacaccgagggcgaggcctatgtgcgaagcgaccagctcgccaccggcgacgccatcgtcaccaccggcgtccaaaagctcgacaaggggctgaccgttcgcctggccggcgcgggagcggaggacgtccggtgaaaggcctcaacctgtccgagtgggccgtcacccaccgtcccctgaccctgttccttatcatcctggtctccctggccgggacctggtcgtacctccatctcggccgggccgaagacccggatttcacggtcaaacagatgatcatcggcgcggcctggcccggggccacggccgacgagatgcagcgtctggtggccgaccccatcgagaaaaagcttcaggaagttccctacttcgacaaggtgcacacctattcgcggccaggggccgtggtcatgaagctggagatccgggaatccacgcccacggccgaggtgcgggaatgctggtatcaggtccgcaaacgggtgggggacatccggttcaacctgccctctggcgtccagggaccctttttcaacgacgagttcggcgacgtggattcggtgctgtatgtcctgaccggcccggacttcaccatgcgccagctcaaggacgaggccgaagccatccggcaagccctgttgcgcgtgccgtcggtgaccaaggtgcggttttacggcgaacagaccgaatgcatcttcgtggagatcaacaacgccaagctggcgacgctggggatcgcgccccaggccgtcttcgactccatcgccaagcaaaacgaagtgaccccggccggcaccctggaaacggccgccgacgccgtccatctgcgcgtggacggcgcgctcaagggcgtcgacgccctggcggaagtgcccgtcgccagtgacggcaaggtgtttcgcctgggcgacatcgccagcttccaccgaggcccccaggacccgccgacctttgtcgcccgccatgaaggccagccggccatcgccctgggcgtggtcatggccaagggcggcaacatcctggaactggggcgcgacctggacgccgccatggcgaacatccgggcggacctgcctctgggcttcgagatcagccgggtggccgaccagccgcaggtcgtggaagaatccgttgacgaattcctgcgctccttcatcgaagcgctggtcatcgtgctggccgtgagttttctgtccctgggctggcgcacgggcatcgtcgtagccctggccgtgccgctggtgctggccatggtcatgaccgtcatgagcgccctgggcatgagcctggagcgcatctcccttggcgcgctcatcatcgccctggggcttctggtcgacgacgccatcatttccgtggaaatgatggtggtcaaaatggagcagggctatgaccgggttaaggccgccacctatgcctggacggccacggcctttcccatgctcaccggcaccctggtcacggcggccggtttcctgcccgtgggcttcgccaagtcctcttccggcgaatacgccggcggcatcttctgggtggtggccatcgccctggtcgcctcctggctggtggccgtggtgttcacgccctatcttggcctcaagctgctgccggatttccaccgacacggccatgaagatccaaaggccatttatcgcacgcccatctatctttggctgcgccgcctcgtggtctggtgcgtgaaccatcgaaaaacggtcgtgtgcctcacctccctgctctttgccgcctccatcgtggcgttctccttcgtctcgcgccagttcttcccctcctcttcccggccggagctgttggtcgaagtgcggctgccggccgggtccgcattcaagaccacggccaaggccgtggaagccctggaaagggtttgccaggcggaccgggaggtcaagacctccaccagctacatcggctcgggcgcgccccggtggtttttgcccatggcgccggaactcccggacgtgagctatggcatcatcgtgctcaatacggatgacgccgcctcccgtgaccgcgtcaaggcccgcatcgaggcttttgccgcccagggaggactgcccgaggccagggtgcgcgtgaccacgctctttttgggcccgccggtgggctatcccgtgcagtttcgggtcatcggccccgacgccaagcgggtgcgggaaatcgcctatcaggtccgcgacgtcatgcgcgccaatccccacaccaccgacgtcaacctcgattggaacgagcaggccagggccatccggctggtggtggaccaggaccgggccagggccttggggctgaccccccaggacattgccgaatccctgcaggcgctgctttccggcgtcaccattacccaggtccgcgacggcatcgaactggtcaacgtcgtggcccgggccgttcccgaggaacggttgcggccggaagtcctggccgatttgaccgtcagcatccgcaacggcaagatcattcccctgtcccaggcggcgcggctggaatacgtctatgaggaacccattctctggcggcaaaaccgcgatttgaccatcacggtccggtcggaagtcgtgcagggcgtgcaggccccggacgtcactatgcagatcgcgcccaagctcaaacccatcgttgacgcgctgccgccgggctaccgcatcgagaccggcggggcttacgaggaaagcggcaaggccaaccagtccatagccaaattactgcccatggccgccggagtcatgctcgtcttgctgatgttccaggtgcaaagcttcccgagcctgtttctggtgctgaccacagcccccttgggcttgatcggcgcggtcggcgccttgttgctctttgaccagcccttcggtttcgtggccatgctcggcgtcttggccctggccggcatgatcatgcgcaacacggttattctggtagaccagatcggcaaggacatcgcggaagggatggaggccggggaagccgtcatcgacgcgaccatccgccggacgcggccggtggtgctgacggccctggccgccatcctggccatgatccccttgtcgcgcaacatcttctggggccccatggccgtggccatcatgggcggactcttcgtggcgacggtgctgacgctgcttttcacgccggccctgtacgccatggtgtttcgtatcgacaggccagaaaagcaacaaaccactatggggagcggacgaattgcgcaatagaccgtaccgaacccacttggcgtcagactcccaggatttgcagaggcccagggtttttggggcagtttcactgtaagcggtcaatcaggcccttcttacgccgcttgagttttgtgtcatggtttattcctacaggaggaagaccatggccacatcagcagcagagggatgttccgagaaggcggcatactggactgaacatattgcggcttggcacaagagcggcctgagtcaaggggcatactgccggcggcatggtctttctcaaagttccctgagctattggcggaagcgtttaggggcaacggacgacgtgggagtcgcgtctttcgtcaccatcgtccccgtgccgctgctcgcgtcggctcaagcagacatggcaaccgtacctgaaccgctgctggtacatgtaggtgacggctttcgcatcgagatcagaggcgacttcgccgcgccggtgctggaaaagcttgtccgcacgctgacacggctatgatgtcgccggtaagcggcgtccgggtttacttggctatgggagccacagacatgcgcaagttcatcgacgggctgtccatcctggtctcacgccagctgcaactcgatccgttcgccggtcacctttttggcttttgcaaccgcagccggacgatcatcaagctgctctactgggatcgcaacggcttttgtctgtggcacaagcgtctggagcagcatgtgtttcgctggccaacccgcgaggcggaggtgctggccattgactcccggcaactcgcctggctgcttgacggtctcgatcccctggccgtgacgggacactcccgcttggagtattcgacgctcttttaggcagtattgccttgattaaattgaataatagtgggaaattgttcgggccgtggacatcaattccctccctgacgaccctggcgcactgaaagctctcattgtcgacatggctgccagtcaggctgaccagcaagagcacatcgtccaacttgagcagcgccttcagctcctgaacctgatcatttacgggcgaaagtccgagaaaaagccccgtaccggccaggagcagcagctctccctgttcgacgaggccgagcagactgcggaggagcacaaaccgcagaccttcgtggaggcctgcgccccggcgagcacccgccgcaaacgcggccgtcgccccatccctgctgctctgccccgggtagagatcatccacgacctgccggaatcggaagaggcttgcgcttgcggcgcgtgcctggtccgcatcggtgaggaagtcagcgaaaagctcgacatcgtgccggccaaaatccaggtcatccgccacatccggccaaaatacgcctgccggacctgcgaaggtgtggaggacgatgggccgacggtgaaaaccgcgcccatgccgccccaaatcatcccccagggcatcgtgaccccgggccttttggcccatgtcgccgttgccaagtatgccgacacgctgcccctgtaccgccaggaggatcagttcgctcgcctggggctggacatctctcggggaaccctggctggctggatgatccgcgtggccaaggcctgcgagccgctcatcgacatgatcatcgctgcaattcgttccggtcccatcgtcaacatggacgaaaccacggtccaggtgcttgccgaaccaggtcgggccaacaccacgaaatccttcatgtgggttgcccggggcggaacaccgggaaaaccggtcgtgctctttcgctatcatccgagccgggccggcaacgtggctgcggaaattctgggcgacttcaaaggctatctgcagaccgacggctacagcggctatgaggccctgggcgaacgggaaggcctgcgccatctcggctgcttggcccatgtccggcgcaagttcgtcgaggtcgagaagtccgctggcaagaaggccaaaggcagcacggcccatgccgtcctcgatctgatcggcaaactctacggcgtggagcaccaagccgaaaagcagcagctcaatccagagcagatcaaggtcctgcgagccgaaaaatccaggccgatcctggacaagcttaaggcgctgctcgatgcccgcgcctccaccaccccgcctaagagtctgctcggcaaggccatcggctatgccctcaagcagtgggaccggctcgtcgtctatctggaagacggccgactgcgtccggacaacaacctggccgaaaacgccatccgtccctttgccgtgggccgcaaaaactggctgttctcaggccatccgcgcggagccgacgcctcggctatcatctactccctcatcgaaacggccaaagccaacgggctggagccataccgctatctgcgccacctcttcgagcacttgccggcggcaaccactaacgccccacgcaaggccctcctgccccaggacatcgatccacaaagcctgatcatcccggcctgaccttctgccgctgcctgctcactctgacaagatgcgtcttattgagcgcttacgagaattccagtgcctgcatcttgtcatgaggtggcaaaaatcaacacttactgtgatcgacatccagtaattgttgaataaaccatcctaacccgggatcagtgtccatcaatttattccaaataaggtacaagccaaaagtgggaagttctactggagcatcaactatacgggcaccagaaaagtcagccaaaattttagcaaccttttcaggaactgaagcaatcaaatttgtttttgacgctatactagcagaagtaaaaaaagaatgagacatcacgacaatttttcgacttagaccaagcttatttaggtagtcatcgataaagcttgaattcacaccagggtgatatgtcctaacgtgtccaaaagacacataatcatccaatgacaaagcatcccctttaaagaaattatttttggacaccaaacaaaccattttttcatcaaacaaaagtttattcgaaaatccttgcgggacgcttgttatccagaatgaacaatcaagttcatttttgctaagaagttccattgtgtagttattggtttgaaaaagattaaaagacaaccctggccctgactcaatcattttttgcataatattcggcaaaaaatacatagcctccatttcagaagcagatactttaaagcatctacgactctctgccggatcgaacgttcgaatactgtcaagattcattaggggtattaactgattttgcagagatttaagcaagtttaatgcgcaagcagttaagcgatatccttttctcccaccagacccatctcgcaccaacagatcgtcaccgaaaatatttcgggctttcaaaaggactttactcatagaggactgactcacatcggccacttctgcagctcgcgacacatgtttttgttcaagcaaaacaagcaaaagaggcaacaaattcaaatcataaccacaactattccgctgaatcatataaactattctcctgaagatatggacacttcttaccctactcgctaaaagatactgacgtaaaaaaagcttgatacacctaaacgcaaaataattgcaagcgtaaattattctagcaaaagacacaattcacacgtttccattctaaacatagaatatttaaattttgaacgctaataaaatgcatcgattattatcaagcatccacgacgggtgtcacaaacttcaccagacactatgtctgcacaagggggtctacacaatgaacaacattaaaatcggaacgagattgattacttcatttttattaatttcactgttcacatgtattgttggatatattggctacaatggaatcaaagaaactaaactgtctgcagatagtgttacaaaagtatttttaccgagcattgaagcattggcacaagtcaaattcaatatgagaaatgtaatactagctcaacatattttattaataaaagatatttcaactgaaaaaaggagtgttcagtatcaaaacatagaaaaagccagaaaactatacaaagaaggaattgttacttacgaaaaactcccacaaacatccgatgagaaaaatgcttgggacgatttcaaaagttatctcgaaaaagcaacagcagcaaacatgaaagggtttgaattaataaaggaatgggaaaacgacatttcaaacgacgataaatataaattagcactgaaacatattgtatacgacactccagaaacaaaccaaaaactatttgaatcgatcgaaactgttataaacattaattcattaaattccaaacttgaacttaaaaaaactgacagccagtacaatgatgtctcaaaagagctggcgtttgccacctcaatctgctctatatcggccttacttctcggtctttttttaacaaaatctattatcaacccaataaaaagaggacttatatttgctgagcaagtaaaggacggaaaattctctgcacgtttggatctaaagcaaactgacgaactaggcattttggcttctaatctaaatcaagctttcgaaaaagtaactgaaaacatgttttggtacgaaaacattataaatgctattccatttcctgtttcagttactgacaacaatatgaaatggacattcctaaacaaagcagtcgaagacattgcaaaagtcaaggcttcggaaatgcttggaaaaaaatgcaacaactggggtgccaatatttgcaatacagatgactgcggagttcgttgtgcagaacgaggaaatggtcaaggtagatcatattttactcagccacagtttcctggcaaagattttttagttgattgttcattcatttacaacaacaaaaatgaaaaaattggccacatcgaagtcattcaagacataactgtagctaatgcgattaaaaaacaagcagaacaagccctaaaagatggaatagtccaagcagctcaacagcttgagtcaattgtggaagtgattacttcagcgtccgaagaactttctgctcaaatcgaacaatctagccacgggtcagaagaacaagctcaaagtatttcagaaacagcaactgctatggaagaaatgaacgccacagtccttgaagttgctaagaatgcttcaaatgctgccggtactgccgatcaagctaaaactaaagctgaagaaggcgccaagatggtcggccaagtagttcatagaattgaacaagtccaaaaccaatcccaagaaatgaaagttgacatggacaatctgggcaagcaagccgagggaatcggacagattcttaatgttatctctgacattgctgaccagaccaaccttctggccctcaatgccgccattgaagcggcccgggctggtgacgctggacgaggattcgcagttgtcgctgacgaggtcaggaaactggccgagaagaccatgaccgcgaccaaggaagtagggaacgcgatccggggcatccaggacggtaccaagaagaacattgaaaacgtggagcgcaccgggaaaaatatcgaagaggtcacaaaccttgcgacaaactccggtgacgccttacgacaaattgtcacgttggctgaaaaaactacagatcaggttcggtctattgccacagcgtctgatcaacaatcagctactagcgaagaaattaatcgcagcattgaatctgttaatcggatttcaaccgaaactgctgacgccatgcgtcaatctgctcaagccgtaggcgagttggccaaccaagcccaggtactcaaacgtctgattgacgagatgaaatctgacggctcggatacgcgtgctatctcggcatctagcctaaaaaaactcgggtagttcaccaacacaaattcaaaatgagggatgggcataagacccaatgacctatccctcaaaaaaaatcatgccatacgaaaacataaaagctatttcaaacagcattatcggcaaagaacgcccagttccattcgagaaaaaagctttacttgcgatgtacttctcagaacttctttcgatgagtttttacgagatagaacagatactcgaatcaataactcgagaaataatgtatcaaattatatattttaacaaccagttcgtagaagatatctacacaaaattttctaaatctcaaatcgaagaaataatgttggctattttcaactacatggtcactgccaaagaagttaacagaaacttggatttgcttaattccgatgaaaaactgaccattgctcaataaacctgagcaaaacatgcagtacactgtgtcccatcctacattggtgatcctcatgaaatcatttagttggctgaaattggaaagaaaatgtttgcagaacactatgtcacttttcaggcctggccagaccaattcaactgccccatctactgaaaatcaaaagatgcagcttcctgcatttcagataaataggccgtttcaagacaatagacaccaagcggggctgaaaaatcgcaggatcctgccattggacacgggtgattatgctccaaaatgtcatctagccggccatcagctaaaaatcaaaaattccagcaaactggacttgttaacttcacttactttttcagctttcttcaaagagaacatatcaatcccttcccttgggagcttttggggattgggcttctcctcggacacccctcccccgctctctaccggaccattcctgggcctttcccactcgttcccttgttgggcttcccctgggccaaaaccccaggaaatcaccgcgtacacccaacgtccgatttccatagagctttgtctagtccgaaattatattgaactggacataagtcgaaaaagacatgctattaatgcaggaagctgctttttggcgcaactttgaaaataccactttggactcgtacatgcaacgccttttactaaaacatttgtcttgaaaaagttttgcagcagaggcaaaaaacagatatacttcaaactcctatcagtgtgcaccaagtgacatgcgagagtcaataggcattttgcactaaactaaacgtcttagttcaagaatatcaacaacgtcaggctgcttcatcgaaaaaacagcacgggcactcatcctgaaacccggaaacctgacggggaggaatcgatgaaagaaccaacagaaagttgcgatgatcagtacttaacttttacacttgaaaaagggctatacgccctaagtatcaatcatgtaagagaagttcttgagtatgtgacaattactaaaatgccgaggacgccggactatatctgtggcgttattaatttaagaggtcacgcagtcccagtagtcgatctcaaagtaaagttcggccttggacaaaccgaaaaaaccatcaatacatgcatcataattaccgaagtaaattttgaaggtgaccaaactgtgtttggaattctttctgattctgtccgagaagtctacgaaatggatgaaggacaaatcgaacccccgcctaacatgggtactgccattcgaaaagattttatagttgggatgggtcgatcagatgatgtattcatcatcattttagatattaacaaagtcttcagtacgcaagaacttgctagcgttcttgatgctgtcggacaagataaccattccgccatagctctttgatctgatatttaagctgatgcgtagcatgctgttcttaaatcgcaaaatttgcaacaacggagggcaaaatgcgaaatattaaacttgggatgaagatcggcattggctttggaatcctcatattaatttcatgctctcttggggtgatggccatattcaatatgtccacagtcgagcacaatgcaaaaaggctatcagatgagtatgtccctgaggtagccattgccaacaacgttgaacgctcttcgtttatgacgatgtacgcatggcgaggatatagtctttcagaagaagaatcatttctcgaagaaggcaaaaaagaacttattcaagttcaaaagtatctatctgacgcgaaagcacatgccgacaaatactctgacttggttaaattacgcgaaaacgtttctttagcccaaggaaaagttaacgagtattcaaagctagcagaccaaacagtttctttaatccaagctctagataaagaccgaaaaattcttaacgactcggccacaagctacattaaaagctctaatgaatttttaaaaagtcaagaagattcactggctaaagatataaccagtggagtctccgcagaaaaactgaaagaaagatcgagcaaaatttcaaagatcaacgacgtgatcgacctcggaaatgatacacgaatttctgtctggaaagcccaggcactcagagaacccaaagttcttgaaggggcgatgagcaatttttccaaaatcgaagatttgttgttcaaaataaaaaacatcacttttgctgaaaacaacctgaaacaattagccgcgatatctgaatctgcgcaagcttacaaatctgcgatgaccggtctcttggccaactggaatgaattgcaaaaaatcaacgttaaaaggacagaaatcggccaagcagttttaagtgctgccgctcagacctcccttgcaggtatggatcaaaccagtgaaatttcgaaggaagcagtcactaatcttgggacagcatctactacaatgattgttggactttctatcgcactcctccttggaattattgtttcggtagttttgacaaaagccattacgggaccagtccaaaagggtgttaaatttgcagaagcaatgtctaacggtgatttcactaaaactcttgatatagaacaaaaggatgaaattggtattttggcagcatccctcaatactatggttgtaaaattgcgtgaagttgttgctgaaatccaatctgcctcagaaaatgtagcctcgggttcagaagaattatcggcttcagctcaaagtatgtcccaaggtgctactgaacaagcagccagcgttgaagagatctcttcatccatggagcaaatgtcttcaaacatcaagcaaaatgctgaaaatgcacagcaaactcaatcaatcgctgtaaaagcagctcaagacgctcaagaaggtggaaaagctgtcatttcagctgtgaccgccatgaaaaatatcgctgaaaaaatttcaattatcgaagaaatcgctcgtcagaccaacctgttagccctaaacgccgctatcgaagccgctagagcaggtgaacacggtaaaggattcgcagttgtcgccgcagaagtcaggaaactggccgagcgcagtggcagtgctgcatccgaaatttctgacctttcgacctcgagtgttcgaattgctgagcaagctggggaaatgttgaccaagatggtcccagacatccagcggacagctgaccttgtccaggaaatcgctgcatccagtatggaacaaaactctggtgcagaccagatcaataaagccatcactcaacttgatcaggttgtccaacagaacgcatctgcttctgaggaaatggcttcgacatcggaagaactctcaagccaagctgaacaactccaaagcacaattgagttcttccaagttggtaacacaggtaacagacggcgttcaatgcccaaagccttgcctactggtcgccaacgggtcgttcactctgccagaagacaaacatctaccgcaaaaatcgatttggatatggaagatactgacttcgaaaaattctagcaggttacgcaaggaggtggggactgccccacctccttgcaatgagcacacagatgaatctttgccaagccatagatacaaataaacaactttttgatatgattcagatggttgggaatacacttttgggagaaaccaaagacagaacccagatcaacaaaagttttttagctatatattttattaacctaatagttcttgaagacaaaagatttcttgaagcatataagaacgctggcaaagaaaacatactaatatcattgtacaattcagaaattattctcgaagaggtggagcaaaatttccacgaaaacgatttctgtcaaattgtccgtctactttcacattttctgataaatttggcggctaacacgctaaacacaaagacaacgccttcatagcatgacttaggagaggaaaccacatgtcacaagaaattcttctcgaaacaggaactaatgagttcgaaattttagagttttttatttcgtcacaaatgtccgaagacctaccaattgaaaccaacttgttcggaattaacgtcgctaaagtagttgaagtaatcgaaagtcctggactagaaataacttacgacaatgtcaatccttgtttcatgggagtcatctcattgcggggatcaattttgccaattctagatctttcaaaatggcttaaaatatcccgccaaaagtctaaaaatgaaatcataattgtcacggaattcagcaaacaaacagctggcttcttagtatctggagtggttgaaatacatcggcttgactggactcaagtcgaatttcctgacaagcttgtcgcatctaacaaagaaaactgcgtagttggcatagtacaaatagaacaaaaaatcattcagctacttgatctagagtacatgatttctgatttgaccggcattaatattgaaacgaaacctagctcctttgtttcagagaataaattccggtccttgatagctgacgattcaaaactcatacgcgaaatgctaaaaacgtctctagaagaagcaaacttcgaagtacgcgagtttactaacggactagactgttggaattttttaagccagatagccgctgaccttcaagacaattctgactcaaaatatactggttacgatatcatcataacagatattgaaatgcctcaaatggatggtttcacgcttacaaaacaaatcaaacaacatgcagttttgaaaaacattcctgtcttgctttattcatctatcatcactgaagaattataccacaaaggccaattcgttggcgcagacgagcaaatgtcaaaacctgacctgcacaaagttccgcaggtttctgtgaaattaattgagcaataccgctcaaagtgattatattgaggctagccaataagctcaatacttcaaaacaattatttcgacactaaccataaaaaatgacttattcacaaaaaacacccaacaaccacaacgcgatgtgatcaccgcaaagcatccaaggtatataatgtcacattctaaagaaatcaaccaccctacatctaaagagattgagactcttagcaagacagttatgcaagacaaaagcttgtttaacactgtcttgaattgtcttccaatgccttactttctagtcgataattcagagcgtattgttcaaactaattcagcatctctagagatgctcaaaatttctggacctattgaagaaacttatggaaaaactttggctgaagttttttacaacgacccaaagcatataacttttatgagccaaactctttgtcaaggaatagtttatcgcgaccttgaagttcccaccaaagatagacacgggaacgacctcaatatcatagctaacattttcccgctttatgacacaaacaatatctgcataggaggaatgagcatttacgttaaccatacagaacgtaaaatgacacaaaaagctttacaagaaagtgaaaagaaaaatcatgacctcatccaaaatcttcatgcaggagtagttgtacacgctccagattccagaattattgtcgccaacgaccaagcttctcagttacttgggctttcaataccccaacttaaaggcaaaaatgcactagacccagagtggtgttttattcatgaagatggaacaaaaatgtccttcgcagaatacccagtatctcaggttatcaaaacccgttctccagtgcgaaatttaattttaggaataaatcgtcatcttcacaaagacttagtttgggttttagtcaatgcttttcctgaatttgaccaaaacaatgaactacttcaggtaattgtaacttttgtcaatataactgaccgtaaaaaatacgaagaacaaattcttcgaaacgagatgagactactttctattgtaaatattcttcaacatcaattcacttctgcacaggattttttggactttgcgctcgatgaagccataaaaattactgaaagtaaaataggatatatatatcgttacaatgaggacagacaggtttttattttaaacacttggtcaaaagacgttatgcatgagtgcagcatcacttctccgcaagtttgttatgaattagataaaacaggcatctggggagaggctgtccgacaacgcaagcccataatcctcaataatttccaagaagagcaccctttaaaaaaagggttacctcctggccatgcatttttaaaatcatttatgacaattccagtattcaaagaaaacaagattgttcttgtcgtcggcatgggaaacaaagaatctgattactctagcactgatgtttaccaattaacactactaatggactctgtttccaagattctcgatcaaaaaaaagccgagcaagctcttgtcaaaagcgaagagacgctacgatccatcatacaggagacaccgataggcatacatatctacgaactctttgaacgcgaacttgtactcactggagcaaatcaagctgcagatttaatacttggcataaatcattcacaattgattggaaaaaaacttaacgacgcttttccaatgcttgaagaaaccaatatctcggatcaatatttagaagtattgaaaacgggaaagacttggcatacagagcaaatcggatatgaagacgtcaacatctcaggaacttatgaaattctttgttttagaattttttcaaaccaaatcgcagtaatgttcatggacatatcgtctcgtaagcaagaggagtttgaacttgaaaatgcaaaaagagccgctgaatcttcaaataaagcaaaatctgaatttctcgcaaacatgagtcacgaaataagaactccactaaacggaatcatgggaatgctacaattgcttgagtcaacagacacggatcatgaacaaagcgaatatatagacattgcgttaagttcttgcagaaacttaacacgtttaatttccgacattctggacttatctagaattgagcacggaaatatcactttagaaaaccacggcttcaacatcagccacctcaccgaagaagttatcaacactttcataacagaattatcttcgaaagaaatcgagctatcaacttccatagaaaaaaatattccagaaattgtttacggagattctggtcgattgagacaaattatttttaatatttttggcaattcaattaaattcacctcaagcggacgtatattcattaacattgattctttaattcaacgccagaccatatatctatttattgaggtatcagatactggcataggcattcctgaagacaaactagatgaaatttttgttccatttacacaggctgatggttcattgactcgtaaatatggtggagttggcctgggactttcaatcgttaaaaagttacttattgcgatgggaggaacaataactgtagagagcaacattgacaaagggacgactacttgcattgccattccgtttcaaactagcgaaccacctattttagacaacaccaacaaaaactatgcgttaccggaaataaattcaacaaaattaaagatacttatcgcagaagatgaccctataaatcaactaacaacatcgagctttatcaaaaaaattggccatttttcaaaatgcgtaaacgacgaaaaagaagccattgaaattttaaaatctgaacacttcgacttaatactaatggacatacaaatgccaaacttagatggagttgaaactactttagtaataagaaattctaacgaaattttttctaaaattccaatcatcgctataacagctcacgcaatggatggtgatcgtgaattttttttacagagcggaatgaatggatatctatcaaaaccattaataatcgaagacctcaacaatgtcatcaaccagactctcgcgaacgctaaccgccaaagagctgacgaggcagtgatttatccgcacaacgaaaaaaattaacaagcatttcagactacacttaataaatgaacatcacaagaacaattcttctcgtcgaagatgacgttattaacagagttgcactttgccgttttctcagcaaacaggggcatgtggttcatccagcaaaggacggcgatgaagcactggaagtatatgcaaaaaataaattcgacttggtaataatggatcttgtcatgcccgggattgatggcgctgaaacagcaagaaaaatgcggtttatatccaacagcacggacggtgactacccaccgatcattataatcactgccattgatcaccgcgcacaaaatttagaaaagatattcagagcgggcgtcgaccgagtagtacaaaaacccatcgagcatgctcaactactggagtgcatagacgaactgctgttgcccaaaagcgcaactaaataatggcaagcccctccccacggacaagaacgagaaggggcttacaatgaaattttctagttactacttcttttccaaaacgatccgcccctcttccaagcaagagaccttgaactcatcaccctggctaaacccatagttcgccagcagcaccggagacaggcggagaccgttcttcgagaacttgactgcacccgaaacggtccgagtattcatcccctcgactttatagtacattccatcctgatccatcagctttagcagatgggctttaagattgttcttattgataccgaaagcgtcaatgatctgctgagcggttttcccttcggtgatcatggtgcgaagtttcatcgcgtcgaatttcgatgccgggggcataggttaatctccttaattttgttttaatgatttaaggagacattacccaagttcctcttcttgtcaacttctagggcaataattctccccaaagatgctcaggcaagatgacattctgcatttaccctgacaggacattcagcttcatatttatattgcgcacgaccaaccacaaaggcatcaatatctttccaaaatccacttgttctagatttatagcacccaacaaaaaatcagctcatttgaccgcataacatactaaaatatcattgtattttatacccctcctctgaccaagcccctgccccggacagcccccaggttagcttcctcctccccgtcctgggccgtttccagggggccagggccaaatcccgcctactccccaaaatcgcagggcgcccccgtcccggcccaaagcctgttttcctccttcggcccgtgacctggatcctggccccggctatcttatcggcggtaagcaagctcatggggcattcgtcggtacacatgaccgcgaaccagtattaccacctgctcggtgacgagaagcgtcgcaccatcgccaagttgccgagcttgaacgcctaagagataattttggcaggggagtgggccatttggtctactccctattttcattatcaaattcaaatttcctgagacttaagatacataaaaaagttttgatcgacatatgggatatgattcataatccaagtcactaaaaaagtaatcacatcaacccgcaaagacatcgaatctaaacgttcgtcaacaataaacctatcgacgctcacaagaaagtcattatgactagaaatgtgttcattaagcatagggtaacccgaagatcgcatcagagactcttcttcagaaaaatgatacctagcatatctatataaatcaaccagcaacacacgaagatcaccaaggacatattctttttctatagaatcctgaagtttattaatgtaaacaaaaagtctctcatgctgactgtctattttgctgtgaccaacagaaaggtagtcatcccactgcgcaattggcatcagcgctcctaaactttagccatacagcccaaattaatgtgcacacggaaaaattgacacatcctctcaccattccggctcaacacttataacgccaaactgagcaacattattcttcccagtaccttttacatcgtacatagccttatccgcacaattcagaagttcatccgacgacatacccaactgatacccagcgaccccaatagacaccgtaaatcgaatcgatccatctgccagctttccgttaattcttggcttgaattcataattttgaacagccaaacgtattgcatcagaatgcagtaatgcttcatcaacagaaacagcacacacaacaaccagttcgtctccaccataccgagcggcaaaccacccatatttttcagaatgtgcactgataattttcgctaaagtcctcaagacatcgtcaccaacttgatgaccatatgtgtcattgacttctttaaaattatcaatgtcaagcatcaagacagaaagaggactgttatctacttgattttgttcgatagcattccgaaggtaagactcaagataccgacgattatgaagtggagctaaaagcgggtcaacattaaccgtttgctcaaggaatcgtgcttttctttcccagtcctttgctttttccttataatgcaacaacatgcttttcagtagaactttcagctttggcctcaaagcttcgaggtcatcagcttcggaaagtacctccaatgtctcccgcccgaaggtacttagcaactttccccgttcttgctctgaagacaatgattcgcttatgaattcattgaccaccattgcaagcgatgatgtaatatttttttgagactcaagctcatcttcagcactgacagtaacctggttacttgctataaacatttcaaggtcatcgataatttgatcaaaattattatccgaagaatcttttctagataaacgactaaatactgttctttgtattgctgatttttgttcatcagtaaatatcgagaagtttccaaccaaattcctgacaaaaagaactacggcgagccaggaaggcttactcccgcatccaatcttgtgcatctcagaacataatttttttatcgcgcaagaatcgctgggacagtcgtttgacataagtttcctttaggaacgttttgacattaacttaaatctctaacccaatagcaccgccgacacaagtactgcatctggcaataccgaactcaccgagactgccagggttggttgtctcggggaaccccgtgcaatccacttactgcttttcatggaaacattttttttgtattttttaaaatacgcagttactcggtattgggtgtgacgtccttcacgatcgccagcaggcgagatagatatggctttgaaatatcaaataatgctgccgttactcatgctccttgccctcctcggcacgtggatgacggttggcaaggtctatgcttcagaaataaaggagaactcaggtcttctggcccagcggtggccgccacccgatgcgtatcccgcgagaccaaaaggtcctcaacccaaccctccaccaagattagggcaagacgacagaggcaggccacctgggccatggccacataggcccggcatgccaccacctcctcccccgggtcgtggatcgcctgatcgccgaccgcccgaacctccccccagacttgggcaggatggctggagaagaccgccaggcccattgccacagacgcccggcatgccccctccaaacttgggctggggttttcccggatcaccagcatccgaaccaaggcaggacggcaggagaaatgctgttgcgtcagagacagaacaaccggtccagaaacacatcccccccgcagtcattccctctggggaaacaccggaccaacgccgcgacagtgaacagacgtccatgacacatccaaagcccaaccccagcccacagcctgaaacaatggcagaccttaccagaaggttcagcagttcgccaatttttatcgcgactggcctcgctacgggctgcgctgcaactattgtttatttgtatatcatgatttgcaaacgcaagaaccgtcaagaagaaactcttcgtgaagaagctgcacaaacatcttcacacaactttcaagatcgagttaaaatggatcacgaagaacagatcagaaagaatcttgaggatcaaagcaatgcctatttacagcgggaagccgctcgacgtcaacgtcaaaagcacaatgaatttcttaatgaatcttggcaacgtgctcaaagaaaacgacaagaaaaaaaagaacgaacggaaacacataaccatgaacagaaagataacaaccaacaaaaagcctcgagaacggcagatcatcgagacatatcgcatgacaaaaagtgggcgtgttcgattctcggtgttaatttacgggcctctccaagagaaataaaacgatcatacattaaaatgataaaaaaaacccacccagacaaggcaagctctataaacaaagccacggaagccgagtttctggaaaaagcaaagctcatcaatgttgcctatgacattatgaagaaataaagtcgcagacgacgagctgtttttcacacgtcgacgaaggtgaacctgggagcctatcagacatcaacgccagcgaggttgagaggacacctcactggcatgctcagtaccaaaatggggaccgtctgcccaaaattttacccgcgcaacacagcccgaccagaaaaacccgcaaatccgggccatctccccagccgtctgcccgtacacgggccaacgtctgcccaaatgttatccaaaattcccacgttatcctgtagggttggccaagatgttatccagcccggttatccacatgataaaaggggccaggccaaatacgacctaaccccttgaattaattctggtgcgcccagcaggactcgaacctgcggccgtctgcttagaaggccgcccttgaatttttaatatactgaaattatttgattttttagcagaaatactgccgccccttggacaaaatcgatcctcgcggggacatttccgtttctccagagtttatccaaaatcccggttatccagggctggagaacctatttcagcgttattcggtagagaacttcgccccctcctgaccctggtccattgcaagccagactcataccgccaagttggtgtccaagagaaccctaggctaatccatctgatcaataaacaatctttacaaaactagcaagaattgatacttttcaaaaaaccaaatatctaggtgtctacatgaatatcaaatcattcttgacgtacttaaaaaaacatttcaatgcaaagaacgaaaatgaattggccacaaaactaaatatttctcaagctaatttttcacaatggaagaacacagaaaatattccacatacttccatagcaaatatcttgaattgtagtcttaaaaattacgcagagaactgcattaaatcaattatagagtttcaccccatcaattgtgttggagattcaaatcttcgttttttaaacaaaaatgacccacaaaacaacgtaattatccaagagcttgaaaagcacaaaggcgtatatacattttacgactcatatggcaaactcatatatgtaggaaaaacaaaacaacaagtgttatacaaagaaatgacgaccgccttcaacaaagaaagcaagcacttgttcatgtggtgcgtggaccaccattgcaaccaagccctgacaacaaataaacaaattcggaaaaaatacgtctacttacatgatattgctaaatatttctctgcatatcgggttgaaaccaagttgatagatgtagtcgaggcgttattaattagagtttcagccaacaataatattaacattaagatggaaacgttatctggcatctatccgccagcatgtaaaacaaataaaaggccacgcctctccttcacaggacgacgtgggccttcctgcacactattcctgcagcactaaggcaattctcacctatttaggctgtctgaaaaaagagtgctatgcagccgttctcagtatctgcctcggggtgagccaagccgccttagtgggctgctcctggtctgatgcgtcggggagctctcgcacccagcaatctgccttttgggaagatgcgacctgccctatttatttcaagaattcagtgttattttagcatgttaggcaattacaaaaacatcaatctgcttagaaggccgctcttgaatttttaatacattgaaatcatttaatttttcaacagaaaaactgccgccccctggacaaaatcgatcctcactgggacattcccggttctccagagcttatccaaaatcccggttatccagggttggagaacctatttcagcgttatccggtagagaactttcgctcagtccccatcacccatttatgactcggtacatactgctggaatcacctgacacttctcttcgcggaacaggcacgatagggacaaatccctatccgatgcggagagttcaaggagaaatcggtatataaatgaacagtcacatctatatgattagaaagaaacgcacctcataattcaaattacaacatcgacaccaaaaaatgaatcctcatcatccaaggccaacaaagggctagatttccaacccagggcagtgtattaaaagcaacaatctttgccggacagattgttgaaaatgtcatgcttgttgttgcattacaacttgcttgttatcttttcttccaaattgtattacaataccagccgtcaaaaaacggctctaaagaaagatcactaccaggcagtgatcccgagagcggtgttatgatcaaaataaaacaattcgtcctgatcgcaaactttcttgcctttgccgctctcggcatgcccaatccgactggcgcaactggattattcaatcaatacgtcggctttggcgacagcactttggacagcggctattttcgctacaacaccacggggagtgcgacacaagatgcagagatcgccgccgccgtggcgggcggagccagcggcgcgttcgtcgggcccggggtgatgaattccaccatgctggcggcacggttcggccaatacggcgggcctgttggcggcggcggattcaacttcgccaatggcggagccttttccgcgccactgcgcgcttccgacagctccccggccctttccggcgtgtccgcactcacaaacgtggccaccaaccagcagatccagaactatctggcctccgttggcggcatagccaatcccaacggcctctatgtggtgaaaaccggtgacaacgacctgcagttcctgcgctacatggggtcgacctgggccgccgccaaccccaacttcctgcccgatctggccatcggccaggctgccaacgtggcgctcctgcaagcggccggggcgcgcaccatcctggtgcccaattcgtacaacgatgccgtgttcgccggcctgggcggggccatcgcctcggaaaacatggacctgtaccagacctcccggtcgtatgggatgatgcgttggacgagcctgaccgcgttcggcgtgcgttatgttcccgccgacatcgacagtctgatgcgcttcgtcgtgttcaatcccaccctgttcgggttcactccttcctcggtactgtcgtccaatacgctctccccgtcgatttccccgctgctcgtcagttgggccgacgtcacccccagccagttgcagaccaaccttttcatcggtgcaaacggcgtgcatttcaccacggccggccagcagatagagtcggattacgaagcgagcctgctgacggccccgagcctcatgtcccttttggccgaggctccggtccagggcggcctggcccgcgcggccgtcatccagggccagatcgacctgtccggacagcatcgcggccccacgggcatcaacatctggatcggcggcggcggcggcgccctgacgctcaagaatttttccggcctgaccgatgtttccggcacgccgtttacgggctcggcgggcgtggactaccagatgccgtccggactcatcgtcggcgcggccttcacggccgggaccatgacccagcacttctccatcggcggcggccacttcgaccagaacgatcaggccataagtctctattccgcctaccaggccggaccggtctggggcaatgtcgtggcttcctgcggctggcagcaggacaagatcgcccgcgacgtgacgcttggcctttttaccgacagcaacagcgccacgaccacgggaacgtccctggcactggcccttcgtgccggcggcgacatccgcctgggaccggtcaccaccggcccggtggccggcctagtgctgcaacgggtgcgcatcagaggtttcgccgaatcagggaccagcggcggactaaccggcagcaacggcgtcacggccctgtcgtttggcgaacagttacgagattcggccataagccagctcggctggcgcgcctcggtcgacgtgggcgactggcggccgttcgtggaagccaaatggaaccatgagctggtcgaccaaagcgaccgcaaggtcaaggccgcgctcacgtcgacgacggccgcgccctactccatggccgccgccccggtaaaatcggattgggccacggcctcggtgggcacttcctacaagatcagcgaaagggtgatggtgcggggctcggcttcggccatggcctttaatgcgcagaccgtcagctacggtggcgatgtgggcgtaagcgtcagcttttgacgcgctggagagtcgtttgtccctcgcggcgagcctctgccgcagcagcggcgactgcttgatcttttcatcgtgctggcgcaccggagaaaccatggccttgacgagaagagccttcctgaagaccggtgtcgccggcgcggcctgtattgcctgcggcgcatacgccatgccgggcccgcatcctgcggccgccgcgacgattccctggaccagcctggagcggacggtgattgccgtccccgtgcccgtcgcgtcgcccgccctgccgccaacggacatcgcccaattcgcgcggtacggctatggcgtctggcagtatggcccggggctggcctgccagaagaggctggaccttatgccgtccggctacagcggtcagggcgtgaccccggaggcgcggctggtccgctttttcaccatcagcgacatccacctgacggacaaggaatcgccggcccagttgatctgtctcggcctcgcgaaacatatctcctcggcctattccccggtcatgctgtacaccacccaggtgttcgacgcggccgtgcggaccattaatgccctcgacacccaagatcccctcgatttcggcctctccctgggcgatgcctgcaacagcaccctctacaacgaactgcgctggtacgtcgacatcctggacggcaagcccatcacccccagcagcggcgcccatgccggggccgacgccatcgactaccagaaacccttccagtccgccgggcttcacaagtcgatcccctggtaccaggccatcggcaatcacgatcatttctggctgggctcggccccggtggacgactatttgcgccaggcctgcctcggcgatacggtgctcaacctgggaaacatcctggccgacggcatggacagccggggcttttatatggggaccatcgacggcagcaccccgcacggctcggtgatcgattccgggccggtggccgaattcgccgccccgcccaaggtcgccccagaccccgaccgccggccgctgacgcgcaaggaatggatgggcgaatttttcaagacgtcctcaaagccggtcggccatggcttcagccaagccaacgtcgatgcagactttgcctgctacagcttcgagcccaagtcggaggtgccgctgaaggtgatcgtccttgacgatacccaacaaaacgaggacttttccggccgggagttcctctggcacggcagcgtggaccagaagcgctgggattggctggtcggcgaactggacaaggggcaggccgagggcaaactcatgatcatcgccgcccacatccccattggcgtggaaaagccgggcgcgttcatgagctggtggggcaaggcctacgtctcggaggaagcgctttttgccaagctgcacagctatcccaatctcctcctgtggctggccggacaccgccattacaacacggtcacggcttttccctccccggaccggatgcggccggaactcggcttctggcaggtcgagaccgcctcgttgcgggatttcccccagcaatttcgcaccttcgacatcgtgcgcaacagcgacgacaccgtctccgtcgtgaccatcaatgccggtccccagcttgaggacggctcgctggccgccgtgtcgcgcggccatgccatagcagccctgcaactcatcatgaacccggctatctcctccaaccccatgctctatctgcccacgggatcgtacaacggggagctggtcgtggggttgagcccggagatgcaggcgaagctgcaaacacacggcacgccgatcccggcaaaaacggccccggcgacaaccggggcctaaacgccacgcctgcgtcacaagccagtcccggctttgcggtgcgcccggatttgccggaggcgctgcggggaaccggctcggccaggggcggcgtggagatatttccctggcgttgcctgtacgggcaagcggacaggcatggtttgggtcgctgcgttttcgaggcaggaattctttgcgtatgggtggcgtgacgccaaaagcatgggaaaataaggcagaccggtgtcttctacaaaaatgctgtctgggctgcgtcgtgttgtctgtgccctggccctgcttgtctgccagccctgggccacggccttggcgcagcaggcaattgtgacgccgatcctcaccacggctgagaacttcagggatattgccggaatcgcggccagtgccggcgggaccggcttcgccaacctgaccagcaacttcggcgtgatgcggaccggagttttttatcgttccaatgtcctggaactgagcaccgcagattggacaaccctctcgtcgctgcgcatcggccgggacatcgatctgcgcacccccggtgaaatcagcacgacgcccgacgtggtgccggctggagccgtctataccaacatcaatgtcattggcacatcgactctgcccaccatgattccggccaacgccacgcttgcgtccctgctcagcgtcggccagagcggctaccagacttttgtgaccaatccggtcgagcgggaaggctttcgcacggtccttctcaccctggcccatgaccctggtcccgatctcttccactgttccatgggcaaggaccgcaccgggtggacggcggcgctcctggagagcatcgccggcgtcccgtcgacgaccatcatgaacgactatctggcctcgaacacctatctggccgcaaccatcgatgcccaggcgacggccctggtggcggcgatcccggaactgcgcggcgtggacctgaccacgcttctcggtgtcgattccagttatctccaagcggcactcgaccaggtgaacacttcgtatggctccatgtacggctacctgatgcagggcctgggcctcagcctggaagacatctatgtgttgcgggcgaaaatggtcaattacactctgttgcctggacaaaacgccttttccggaaacgatgtttccggggcctcgtttttaaacaccttgcagaactcctccctttccggccattataccgcctataattactatctgcagtcgtcggtggacgcagggacgctcgggggtgttcagaggcaggttggcggccaggttcatgccgatgcggcatcctacctgttgcggcagcctcgttggatcgatgcggccatcgcgccctatacgaacagccgtgatctttccgaaggccaagcccggatgtggctgtccgggatggggagcggcttctggtcccaggctcgggcaggcatttccccgagcacggaacacagcgccggcacgcttatcggcgtggcctaccgcccaagcgagcgggccagcgccagtctgggcctcggctataccgccggcaccgtcgaaagcgccgcagccaccgccagggtgaacacggtcatggccacaatcggcgggcgctacgggttttcaagtctggaaaccggtccgtacgtcatcggacgtgcagatggcggttgggtcgactaccaaagcagccgtcccctaggtggtggcctggggacggccagcggacacaccaacggtgcccttttaagtggattagccgggttgggtgacgtcattcgtcttgagccgttcacgtttacgccccaaataggaattcgcgtgacgagtcaaaccctcaaccgatttacggaaagcggcagcgaagtcgcgcttggcgtccatggcctcgacaacaccgccacgaacctcctgctcgacctggaagcgagacttgatccgcaacaactgggtacctggaacataacacccgcagtcctgctcaggtatgagcgctacctcggcaacccccaggtcgaaagcacgggaacgcggtacggttgcgccgtgagccagaagtcggcctttgacagtcgcgatctcatgactgccggcctaggtgttgttgccaagcgcaatgccctcaccctggagggcagaatcaatgccgtagtcggcgacggagcggggagcaccggtgtcagcggacaattctctttggggtacagcttctaaaaggtgtgcctcccccagcaatctgccttttgggaagatgcggtctggcatatttttttcaagaattcagtgttattttggcacgttaggcagttgcaaaaccatcaatctgcttagaaggccgcccttgattttttaacatattgaaatcatgtaattttttaaaggaaaaactaccgccccttggacaaaatcgatcctcgctgggacatttccggttctccagagtttatccaaaatcccggttatccagggctggagaacctatttcagcgttatccagtagaaattgcaagcttcgtgacaactcccgaaacaatataaacataaatagggtttaaatcgaaccaaaccgagcttaaaaatattagatcataatgcaaagcgacactataaagctaaaaactacagcaaggatgaaagcgaatccttgtcaacaatattgctaaacaatcgtttaaagccaataacttttgcaccgttaaattctgtcgaagcacaaccatccttccaaagactacaactgtcaacgcgaacattaaaacgatccacaaacaactcaaaacttttctttccttcacaaacaatgatctttggcatgcattccgaaacaataaccatagcgcattcctttgaaacactgtcaatatctaattgaaaattattcttgatcaagcccaaaagcttccacagatcgcgctgattatcagttgcgaggaagtagtgattgatctttgtcgagcaatctaatttttcagacttttgtgccttcttaaaaacatctttaatttctctagccaaagaatagtttcctttaatatattctagttctatttctggatcaaatttttggactcgcaatccatgttccccataataccctgagccaggattaagcccaacaaaaagaacttcaggtttcttaattagtggaccataaaaaacctgacaccctttatataatttatcaatttcagaatcatgcaggcatgaatccaaaatagtcttatccaaatccttaacccgagacaataaagaaaccatagaattcatacaatccccctacaaatacgaattaatcgcgcccataccacagcaagtgaagtcaattcaacagcacaaggacaatacatgatacaccgaaaacatttttcagtcgaaagctactggagaagaatctcccaacattcgggcataatagcgagcatatcatcaaaaacttgtaccactatagtctacgccgaaatgatcatagtagtaaattcggaaatattctatttttctacaatcagacaaacaagtcaagccactaactatggttggcagaaaaaaacatctgatattgaaacttgccaacgatatctacacattcacaaccatcacacagctgaattcatcaacttgttcacgcatataatccaccgaaaaaaacatggcagcacttgggttaacaaaggccctcaaacgctccacaatggaatcaatgaaatcgacgccaagctctacttttttatctaaaactaaaaaaacaaacagccctgtcgtttgtcgaatcaaattttcatgtcttaacacaaaagcatctaaactcgcaacagcgtttttaaatcccgactcgaagcgcaccccgacagaaagcttgccgcccatgacagacttcaaatcagctacatcaacgcaaatcaaagaccttctcaaaaaagcgtgtgcgatagtatctaaaattcgagacaccgcatcattgtcagtatcattatagaaagtcaatcctgcaaaactctctccaaacagcccagagcaatccaacgcactaaccatcatatccttaaaaccaaagacacttatcataaacaacgcgccatcagaagtcaaggcatgctggttcatcaccattctattcaggtcttctgatccaacaacaaaacaaagcatactcatgtttgatatttttgacaataagacatcatttacatattcgactacctgcaagcttgaagcaaccgtcttgccttcaagaaaattccaatccgagcattccatatcaatcaaacaagaaccaacacttttaggcaaacagttatatgcatgcttattttctttatgaacaggcgcaacttcagtgacgattatgttatcatactcatccatataatttccagcataggcaagaaaaacacgtgcgcaaaaatgttgtctcactgttttgactccaaataaattgacacaacgtcagccaccccggcttatccggggtggcacataaacagatcgatgccggcccagcaaggttgtctatggtaaagcaatatctagtttcctagccaaactcattacaagttcttccccttcgtaccgctcgcaatagccgtcctcatccagggaataggtctcccctgcgtttgtaccccggctatggttgatcccatgccccccttttagcacaacaccatagatatctttatccgaatctttaaaaacatatacaagacttccgttatatgtttgataaagacaaccatcttctggcaccacagcttcagtgtccttgaattgttccaatgtagcaacaaccatcttcaatcgcttaagtgtcgcagtaacttttgacatgccacttctccattcagacaatttggttattcatttttttaccacagaacacaacgaacacaagacgcaaaacaaccaaagaccacaccaaaacaaacaactcaataaatatcttctaaagaataatgtcgttaccacaagcccatactttcataatcaaatttgtccaaagggaagcgatcagattctgtccaaccctcttctttgagatctatgatgatatgctgcatggctaccttctcggcatagtctccaaaaatttctatcgcctgcttgactccagccgcatggtgcctgagtttccgatgccgggtcatatagggttcgacaccatgaaattcatcaagccaacgatgtatctctgggtatggattcccaaactctctctgagaagcctcacaatgcttttcgaaggtagccatgcaaattacctattcaaaaaccacatggaaataaatctgctcataatcatcagaccgaacaaacacaaactccccattgccgacgaagcagtcaatcgcaaaccactcctcctcatcgccgtcttcgtatgcatccgacttgtagaaccattttgaattttcctttttgaagacgacttgaaattcttcatcattgccacgaagttcgacacgcagggtgtgttccttcggattgactacgattgaatccacagcagatggataataaaggccagcacgctcatccctatcgatccaaaaagtgtagacatccgcaatgttgtttttaaaaatatccatatttctccctagacattactggttaaagcttttaccatctcacacttgaaatcataagcacagcgtgccttttcaaccaacatacaaaaacgcaactcgattccttcaatggtcaacgatgaacctgtgttccaataactacagctgctgcaaaactcaaaccgactatccctcttttcatcacctgacgtcaccatctagccctccctgtcagccatgggcgggatagtagttgcggaccgttccataattcggtacttttaaagaaatattttattgtttaaaaacagatggttgcgcaaatgccgcccaaaaaagaccaatattcatcaccttcacaaaaaatcctgaaccttttcagcatattacttttcaccggacgccaattttcacttggacaaattgctgaaatgcttgaatgttcgaaacagaccgctagcagaattaccgaggagctggcccgcacgcgtgacattcagcttagagtctggaaggaagaccgccagaaatggttccaaatagagtcatccccgcgtccgcacgtgtcactttcccccagagaaattcaattgctggggatgtgcaaggaactcgtttggcatcttttgccgaaaggaatctctgaggaggtggaaagcgctcttaataaaacaaccgctcttctccccaatatggcaaacagagcggatgccctcgactcgatttacgatgtctcagttaaaggagctatcgactacacaccttaccaagatattattgaaacaatcctacatgccattcgcgaaaaaaatgtttgtgaaattatttaccagtcaccgcatcgctcagaacccaaaagtcattgtttcgctccgatgaaaatcatttcttaccatgaatccctttatgccgagggtttttcccttaacaatgagacggaccaagagatactgcaccaaacaacattttctattcataggatcaacgatgcaacgatattaaaccgcaaacatcatttcgaaactcgagaaaacgaccagaaacaacaagcctttggctttatggaaggtgaaccatttccagtcttgattaaattcactccgcaggttgcacattatatcaaagaaagaatatggagtgaccaccaaacaattaaaagctacaaagacggcagcatcttattaaaattcatggttcaaagcgcgccagaactaatcgcatgggtcttaagcttcggaaaagaagcaaaacttataaagcctaaagctcttaaagaacgagtcgcagaagagctaaaactaacgacactactttacaactaaacaaaccgttctggagctaactacatgactgggttagttatagattttgaaacaaatggattttatcgatcttctgttctatctgttgccgctataaaaatagatgtcgattggaacctcaaaaaagtagacaggctcgatacattcgtgcgacactatcatccagttgaaaagtggaatccgcatgcacaagctgttaatggcctctctgcaaagaaaatagaaaggctacgaacaagtgccgaataccccgcctactttaaggacgatcacgggttaactaattttgctagcgaagctgtgttcgcagttgcccacaatgctaagtttgatagtagcttcgccaatctccagattccgtggatatgtaccatgaaactttgcggcggcaaattagcggatgctgcaagattgagagggattgttgtcaaacaatctcaacttcacgaagctctatacgacgccgaagtttgtttagacttattcacacttcttgtacgagatgaaaaatatttgccacaacaagactcacagcttcgacgacactacaacactaacaggtgactattggcatgcttcaacgacgtgatgctctcgactcaacaactaaaacaaggagaatatatggaaagtttcggcgacgtggtctacaaatcaaatattggagatggcccaggaataagaactactaaagattttttagaaaaaatgacaaaaaatctactcttaaactcaaaagagtattgcgacatcaccgaggaacttcctctttgtttcaaagaaaagcaactgctgccgttgcttggttctgctattcagaaaactaccccagctttcatgggtgaagtaccaattacacgaagttcaattttcaaaaaaagcaaatcatcccctggatttgttgacttttgggctacatatcgcaacactagtttttttatcgaagtcaagcacagtttcttttcttatttttcgcaagaaataaactcacactcaataaaaaaatgggagacggccattacccaactaaaaacatctgcaaaagctttacgagaaggatggaatatatcccagcaagccatgctcatttcattaatggtaatgccattttacatatcagaatcagcagtcaaaaaacaaaaaagagaactatcacccaagaacatagaccagtgcagtgccagcatcctaaatgcactagttccagactggtattcaacttgctacttaaatggtaaatattctgggccttataagtacctcaaatcaagtgaataccatcctgcgatcggggtctatgctaaaattattaagtgtaccgaataaacacttaacaggccgttgcaaaaagctgtttccggctattctcccccgcagatgacggcgatgggcatgattccacagcatcgtccttcgaccaccatgacgatggccaaataggccattgagggatgctgattgggccaaatgagcgcaagccaggcactggcccagcccctgggggtgccatggccggtcttgacccgcatcagcaggccgagattgaaaccggccacatggagcagataccgtttctggatgttctcccgtccccggagccagacccggcgcataccgccagaccggtccagcgtatgctcgaagcttctttcgaccagttccgtccgctgttttcccatggccttcccgaccatcgacgatatccggattcggttgttgtacacggcgcgccgcgcctcatgatcgccacgccaggagttcaggccgttgcgcttgggttcggcgattctcgtccgccatggccctccgtccaggtctttgaggacatcccgggagaaatagcccttgtccgcgaccagttccgcaggatcgtccgggcatggcggtgtggaagtgacccgtcgcaaactttcttgagcggctttcagcgtcttttgcagagtcgaagtgtcccccttgtccgcttcatgcacctcgaccgccacgaccgcgccggtgtccaggtccaccgcgtgctccggcttgtacgccagatgcgttcggccatccttcatcttggcgatcttcgcctcgggatcgacctgcgactgccagtccttgttcgaaagcgtcttgccgacgcgcttgcggtccatgcgagccagatcctcatccgtcggagagtcgatgccgctctccttagccatgcgcaggagcatcttgcggtagctctcacccgtgtcccggcgcacgatggttttgagcgccgcgttggcctccatggtcgaagcgtccacgccaatgcggcctccaaggaccaagccatccttgctgagcagcttgagaacccaggtgaaaacctcttggtgggtcgccagcggcagacgggaccgtgtccgactgagcgaggaatgatccggcacagactccttgggcgaaagctggagaaaatcccggagggaaagcgaatcggcgcagcgccactcaatgccgcgctcgctgtcgatgccctcgaaataccccacgaggtgcatccgaaaataccggccaggcggaatggagggacgccccttgtcggaatagaagggcttgcacagcttctcggcgaaaccatcgaaggcggctttccggagagtctgctggagacgatcgtaaaaagcgtgcccacgagaccgaggaatctcatcccaggccagatacatcgtcccctgctgatcaccctgacggccaagccccatcagatcacctccggaaccgcgatggctggattctcggtcacttggcggagtttttcaacacgctgttaaaagaaatttttttaacaaagcccacgccaaccaattttcctggacgacgtgggcctttcagcataactacctgaaaattcgcactaacttgacttcttctccagcacgattttgccctcttccagacacgacaccttgaattcatcaccctggctgaacccatagttagacatgagggtcggggacagacgaagccccgtggtcccgaacttggcatttccagaaacggctctgtcccccataccttcgatcttataaaacttctcgtccatctgcatcaacttcaagagatgggctttcaacgtcaccttatcaatctcgaaagcatcaatgatctgctgagcggttttcccttcggtgatcatggtgcgaagtttcatcgcgtcgaatttcgatgccggaggcataggtttatctccttaattttattttaacgacctaaggagacattacccaagtttctcttcttgtcaacttctaggcaataattcgcccccaagatgctcagcaagatgaaattccgcatttaccctgacaggacattcagcttcatatttatattgcgcacgaccaaccacaaaggcatcaatatctttccaaaatccacttgttctagatttatagcactcaacaaaaatcagctcatttgatcgcataatacactaaaatatcattgtattttacacccctcccctggcccagcccctgccccagacatcccccaggctcgcaccctcctcccctccctgggccattcccaagggaccagggccaaatccccacccgctccctcaaaacgcagggtgaccccgccccggcccaatgcccgttttcgctgccgccccgtgaccggccccatggcccaggataccttttccgggtccgattcctggcccacgaggtgaacatgccgaccgaagcagaatccaacgacaaggcactcgaactggtcgaggaaatcgtccaacggtttcggccgatcgagcagctgttcgacgtcatgggcgcggcggatgctggcgtgcagggcgtctttgtgcgccgatgggctgaaattggcacccatctcgcgacaagctttcgggaacacctcgaccagatggtcgcaatagccaggaacgacgaccggagtcctggcaagtcatcaacttcaacggaggaatagaacatgatcattttggaatttatcgccggaatcgctttgggtgctgtagctggcggcgtcatcaaggtgatcactcatggtggcggtgccattgtcggaagggacaatgttcgaaatgcaatcaagaaagaagaaaggaacgtacgtggacggttcaacgacctaaaggtcaccaagaacgacccgaagttctacgagtaatcgagaacttgccccgaaggagaactctcatggacgactggccgatcatttacagctacacccgcgcccaggccatcgccgacggcgtcctaatcgacgtcaccgcccaagccgccgaggtgggcttcaaggtgcacgcggtggtcaccgaccatctatataatagctatgtggtaccgccggccgggctggaaggcgaagggcagtccgtcgagggccggcttcacgacttgctctttcgcaccctgctcgctgctaaggctatcaaggatagcgaccgcgccgaattcgacgtccttttcctcatggcaccggggcggtgggacacggcccatgtcgtggcggtcatcggccctggtgaccaaggcgagccggtcatgacgatcatgctgcccgaggacgattaaaactacctgaaactacatgacaaactgtttgtaacgacacgcactaatttcagacgaaatcacgatgaaatcgctgcgtgactttttgaaccaaactgtgaaagtggaaataatctgagcttaaagcgtagaaaaatattctctagtggtaaacaaaaaagtctcaccccaggattttgagcaccgaccttgaaaagacaaggggtgagtggtaaatttgttttttcccttgatccgccaatattacgagagccagaggtgcggtcttgtacattgtgcttaaaacatacgccctcacaataaagaacagtgaaatttaatgacatcacttatttccacgctcatattttctccgagaaaaacctagagaatcaagcttgctgcggaacgtagaataattaacgcctgcatgctctgctgctttaagtttggttttgtatttatcaattagatatttataatactctctaagcaaatcatcctcattcaagccaaataattcaaaatccattctatttacatccttaccacccataatcatattaaactcatcatcagtcaacatctgctttacatgcatctcccaagactcgttaaaggcacattcgtatttagtagcgatcttaacgccagctacaaattctaaagcttgtttaaccaaatttttcttgtagaatttctcaaaaatatttctttcaagactgcttgtccaacacgtatcagcgatagaatgttcatgggaactaaatatatctttagccgctcgtggattctttaaaaataatctacaaagagagtcaaaacaaatgccaacattttcaatcttatccatagtgttaattaaaaatattttctcaaatagctgctcaacacaagatgaatcacgccaaacaacaatcgatttataataattacatttacagccttgagcttgttcataattggccaaaaaatttgcctgatttaacattacgaactcgtaagtttttttctgagttgtttgctcataattcaattcagaataatctatatcatcgagtttatttaaacattcttcaatcaaagtatccaaattatcgttaatgagcatttttatttgtttgtaaaaatcatacaaatctccagagagacttaaggggaaaggtatggaaagaccatactttaaaagtattttattaagactattgacatcaaaaccattgccagcaagcttcacattgaaatcacacaaagacgaaaaagacaataacgtttgccgcttgtcactaggcaaacacaacggattcgaatccatccctttaccagccccactattaccctggccacctgacaccaagctatcttcaagcattatcaaggaaataactcgctcaatttctcgaacatttccaggccaattatacgacaaaagtgtaagagcatgctgcggagtaagcctacagaagatgtcaggatgtttgtacgcaataaaatataaaacatctagtcgtctttcgtgcacaggtggtataaaaatcgggaaaaatctaaaccaaaaatcaggcctaaaagacttttgggttttattggtagttcctataattttcaaattagcactttctaatttattacttccaacccggcgatacctcccttcttctataaaaatcaataactttgcttgaacttcttctgaaagctctccgatctcatcgagtatcaacaagccaccatccgcaacttttacaatgccttctttgtcacgagttgcgcctgtaaaagcaccttttatatgtccgaatatctctgattcagcgatctggcttgtgaaagatgcacaattcaaacggacgattgatttaggagaaactccataacttaaagctatttgagttgcagcctcaagaaacaaactctttccaacaccagaatctccaatcactaatattggagttttgtgatacaatggattcttcaacaaataatcttttgcgatagttgtaaattcacaaaaaaccccttgctgtccaggcaaaactatccatgctttttctttaaaatcaatacccatactttctccatacattaagttttgaaactctagatttacaccatcaataaatgaccatgacagtcgatatttaagcacacctcaaaaccagcaaccaacgaatgccctgactcgtcaataccgtcgcaaaacctctaactgggcaggcctctacccgtcgtccagccttaaaatcttcccagacaaaacctccgacgtcaacctctgccagagaacaaacgggatatatcgcattttatcgtggcatatcccgtttacaaacacatttttctccaatctttgacaaaaaattcaattatttcagcacagataaccttggcacactttctgcttttagctgagcatctttgacaacggaaagtgccaaatgagccaacgccggcacattgctgtacgccaacactttcccacatagagtgcagaattgttttcaagcctgagtcttcatagagggtcaagccaaccctttacgaatgacgcctggaatcaacatcaacattctaactgagttggcgttgttctcaacaagagactttccaccaacaagaaggagaattgtcatggcttgcaatcctaaagctcgcacggcgagcaaagaacagaaagatatctttgtccagcaattcattgagaagtacgagaacaagaatggattgcctgtcgaagttgacgtgaaggacgccagcaacgccttcaacgtgtccacttctatcatcaaggaaatctacatcgatgcgatcggcaagggaatgcgcaatgtcagtttgaacagtgcggaccattgttccgataaacccgaaaagcagtccatcaactccaaagggaacttcattcttccgaaagatacgatcgcagagttaaacaaaactctcgaagaagaacggaagttcaagaccggggacaagttcaccgccacgcttgagggcgagaggatcatcctggacagggttccgtgtgaattccctcaggaacaggatgcacccagcgaagcggcctagccgacacccgatcaccccaaaccccagcggcgtggttcgcttagtgacgcgagccgcgccacccaaaaaggtacccatgaccaaccacacccatgagacccctggaagcccggctgacaccccctcggcccacgacagcgagtgcgacggcgacatgctgctgccgctgttaggcgcgccgttcgaacccgtcgatgaagacggcaccggcaatccgcttcggtcgctcccctgcgacgaaaacggcgacgtgttcctccccctcttgggcgacgaggacgaggccctgacccctggcaacaccaacacaaactttcctacgaacgagtacaaaacgatgaacaactgtgactatgctgcgagcttccgtgaccttctgggaaatcttgtggtcgtcaaagtgtggaacacttggcgcggattacgcttcacttggcagaagacgagccgtttcgaaatctcgccgagcctgcgtgacctctctaaagatatcaagctgtggagcatcatcaacggcaacttcgagtctcgagagcttcttgtgaccatctaccacgttgatgcttctatcctgacgaagggctacatgcaccgccttatcaggtccatgatcaagcaccacgcgaatgcgaccactattagcctgcccaagttcgacgacctccaagcctatatcgcctggaacgcgcgagcctaaccagcagacgccataatggaaccgatctaggacgaaagagaaagacgaggggcttgaaaaaacaccccaagcaggaggactcatcaaaaacgacaataacatgttatgcgctaagcacaaacatccgaaacaaacagcatcacatcgaaccaacctcaacaaataacaacaccaaaacattgggcaaaaatgccagccttgcgcaccctattggtgcgcgaggccattctctcggtatttaaacatctaccgaagagaagtttagcatgttggatcatccatcatcgacagcgatgaagcctagcgagttctggagtatcctttggcttcaataccaagggaaaggggtccaaaacctttggacgctcccagatacgaagacctacaacttcgaatgctcaacggaacttggctctatcgacgatactgtcgagtcactcgtacaagaaggcaaggacgtctacttccaggtcggactgcaatcccaaaaatggggtgcgcataaacgaggcaaggaagagacaaccattgccatccctggtttctggcacgatgccgatatcgccggcctgggccataagcaaacggccctgccggaagacttggacgcggctttaagcctgctgttcggcttccccctcaccccgacgctgatcgtccattccggcgggggtctgtacccgttctggcccttgaaaacgccctgggtcttcagctctgacgccgagcgagaagcagccaagaacctttcaaagcagctccaggacgcgctgaacgacctcggcagacagcgcgggtacaagctcgactccacgtcaaaccttgaccgggtgcttcggattccggggtcgatgaacttcaagatacgcgagaatcctcgccccgtgcgcgtcatccactacgacccaagcaagcgttacaccctggacgagattaaggatcgtttgccggcacgggctatctctgtcgtcgcgcctccagcccaaaaggggacgagcatccccccgggcgagacgaaataccccccggccgatctgaacaaaatcgtccaaggctgtgcatggatgtgccacatccgtgacgatgccacggccttaaccgagcctgaatggtatgctggcatatcgatcttatccagatgccaagacggtcgttctataacccatcaatggagcaaaccttaccaaggatacaaacaacaagaaacagacaagaagtttgacgatgctcttaacaatgcggggcctcgaacgtgtgaaaacatcaggcaaagctgcggcggcgaagcatattgtagcaaatgctcgtcgtggggcaatatcaaaagtccagcagtcctcggcatttctcaagccttcataaaggagtatgtcgcagatagcttgcctggggctcctgtttcgcaaggcattgtcataccggaaggatacgtcatcagtttagagcatggagttgaacgcatcgaaatgcgaggcaaaggggacgacaaatccgaagtaaaaataaaggttcttatcacacctcttgtcatatctaagcgccttgtcgatgtaaacaatggcgaggagtccattgagatcgcttggtatcgcgatggggcgtggaaatcacggatagaatctcgttctacgatctttaccgcaagggagatcatgagcgtcgcaggacaaggtctcgctgtcaattcgaatacggcgtctttagtcgttgcatatctggcagactttgagcaagcgaacagagacatcatacctgttgtatctgtcacatccgtattaggatggcagaaaggcctgaagacctttctttggggcaagcaggttcttgcgtctcctggctcaaacaaccatgtcgtgttcaaagcgcaagaggatggcgacgatcagattgcctctgggttttacgctaaaggatcataccaagcatgggtcaaaacaatcaacagtttgtatgaccacgaacgatcgatcatgatggtctatgcttcgttcatccctcctttcttgaaaatcatcgaggcaaacaacttcgttgtcgaccttgcattttcaagctctaaaggaaagtcaatagccttgcgttgttccgcatccgtttggggcgacccttctggaactggaaacacggtgttcttcacgtggaagacatccgaagcatggattggtcaaactgcaacgcttgtcaccgaccatccgttaattcttgatgaaacaaagcttgccggaacagccggcaagaaaggagaagcagcaagcaaggtaagttcaacgatttatcaggtatcaagcggacaagataaaagaaggggttcacttaaaggaaccaggagaaccggcacttggcgtttggtccttttgtctaccggggaacaacgggccgttgatttctgcaaggaagacggcggtgcccatgctcgcgtcttaagcctttggggaatgccgttctcgggagacaacctcgcagactacgtcaacgatgtcgaactcacggtcaaggagaacttcggccatgccggcccaaaagtagtcgagttcatcctcgcacacagacgcgattggccgctgtggcgcgagacctatctggagcttcgacggtattacaccaaacgtgccggcggcaataacatcgcggtgcggctcagcgaccacctcgccgtcctcaacacggtgatccccttggtccacgccgccctgcccgagttgaagcccacgcggcccatcagggagtaccttgatggcatctgggacacggtcagcaggaatgccatggaagcagacagagcgaccgttgccttacggcatgtatatgactggtcggttgcaaacagagacaagttcttcgatggcaatgctcacgacaacaaccagacctatgttccgtccatgggatgggctggacgctgggacaatggcaaatggagtgagatagcttacctcaaacctcagttaaccaaactgatagaggaatctgtcggtgaacccgatgcgatcatcagaacatgggcagaccgagactggctgtacaaagacaagcaaggtcggaaccaacgacaactgacaatccgtggacagaagacttgggtttactgcctcaagaagtcaaccgtcgaaaaggaacttggcatcaaattcgatgacgacgcaacatcgacgaccaaggatttaaaaccaccgttttaaataaaaggggaggaaagagggcatcctgcggtcctgagggccgcaggacagcccgcaggacaaagttttataataaaaacaatatgttatttacaatttcctgagaatcctgaaggatttagggggtatggtccaaggggcaccaaaacgccatttcgcccatcgggctccttcccccaaagggccacaccctgtttttgcgcagtcccgcaggaattcaggaaatggtttataacatattaaaataatttatttttttaacaaatctacgtcctgaggccctcaggatttttcaggactgccctaacaaggatgcaaatccggaggataatatgagttatttcgatgaaatgctggatcgatacggactgtcccatgacattttcggcctgtcgcctgtcaccacaccggctttacgggacacaccggtcgcatcgaattcacaacctattttggccgcaccagacgagacgccggcaccggatacgcaggcggaagcgaccgcggtgcccctcgagatcgaaaatgcgcctgtcgtcgaccctgcgccagagcacgacccttcgttaccgccgtgggggcgtgacgaagacgacgacctcctcgctggtatgccggatttaatcgccggcaccgcagagggcatcttctagtcaaaagtggaggtgaatggcatggcggtcgatttcagactgccatgccaccccatggaccaaacaaccaggccgagctatgcatatggagtctgccgtttcgttcggtcagctcaagaaaaacaatcatgagacgtcgagtttatcgatcatccgcataaaaaagttacctgtttcacgtcaaccagaacgatacatagagatacaaacatgacaataatcgcggttcgtagacagaaataagttgataatatcattgtatattacagaatacatatcagactattttgaattttcaacttgcgtttctaacacgagctttcgaaatcgtttcatgtctttcagaatttacgaatgatctttcaaatataagcgtagttaaatcgccatgggtgccttgcatcaagtcggtggtcgagcgttgctgatagtgcaaccattatgtatgacctagatacataatgcggtcgaaaaatgtacttgactcagaattatcaaacttcttgtcgatctccatcgaacaagacttcctgagcatgatctactcgatatgaagtaattcagtcgggggagggattgagaccgaatgactggcccgtattcatgatctttcatgaagaagctatggtggcgcatatggtgaacgaggttcatggcaaaccgaagtttattggaatctccaattccgaagatatagttaggtgacgtatcttctgaccatatgcaagcgattaggcgtgggactgtcagaaatgaccagacttaagaccaagggaaatccttaggggatgcttttcagtagaacgttggagaagtttatgtcctataaggatggctgcgtatccgtaagggatacggcaagagatgttgctatttgaaaatcattcagaaacctgaatagacacggaacttcgttttgaatcctcaagatacacttgttgaaaaacttcgaatagccttgatcgttctggaactaccatgatttttcaatacatctcttgcttcagcccaatacggggaaaccgtacgttgggttgtgaaggacgcttgatccggcgacgaatcattcgatcctaaagtcgctgtcctccctggtggtttagaccatcggggacgacggcgagactacgcgcttctgctgaggaccgcgccttcgggcatggtcctctttttcgatcagaaattggaccggacggtggccccatggcccgcccccgatcctggccccggccggcccacaaaaccggccctgtatcctccccgccctgggccgtttggaccccgccccatagtttgccctcccccgtgaccaaaacccccggaaatctgaccctggggccatagcccgttttccaccggggctcttgccgccgtaacgggccgcttacgagaaatagtaagcaagtaacgctactttttaagtatcttcgagcaaatacagaaattatcaatcaaaccaaacaaaggagcttgtatgagcaagaagactgatactgcggctgtggaaggacaggatggtttcgacaagaagaagatcgagtcgaagtacaatccttcgcttcttcgcgagtgcatcttcaacggcatggacgcctcggagatcatggtcaagatggatgtcaagcatcgtcagaccttgaagcaatacgtcttgaagctgatgagcgacgacaagacctactacgaggtcaagggcctttacctcaagaattcgaggaggcccaaggtgaacaacaagatggaactgaagatctatctcaagagccttgacctacaaggcatgtccatcagcgaaggcgacgagttttccattctggtcgaggatcagaagatcatcttgaccaaggtttagtacatttggactttaacatagtcatatcgcaagatgtgactatttttcgattctttcgcgcaagatcgagaattatatgcaacttcatacagaaattacacttatagcgaatgtacgttttgtacccaaaacgaacattggaggcatttatatggacttctgcaagaaatcaaaggcgttacccccaggggctttggagctcaaggggacaaggccgatttaaatgcacgtttccagcatggtcggaagaaaaacaagcattggaggcaacgatgaaggtcgaacccattattgacgtgaagagcatcaaaagcatcaagaagatactttctgacaatcttcgcgacaaactgctcttcatcatgggcatcaacactggacttcgtgtccaagacttgcttgccctcaaggtcggcgacgttcgagaatcaaatgtcggcgaccgtgtggtcttgcgcgaaaagaagactggcaaggagaacgtgttcattatgaacaaagagatcaagctagcgcttgatgaccacctcaatgaatcaaagctaaatgatgagcattacctgttcaaaagtcgtaaaggaaaaaactatcctctcacgacatttgccgtcaccaagtacgtcaaagcgtgggctgaagctgttaacctgaaagggaactatggggcccatacgttgcgcaaaacatggtgctaccaccagcgcaaggcatttggcgtaccatgggaagtactggcaaagagactcaaccattctagcccatcgatcacacgtcggtatcttggcatccaggaggaagaagtcgaagaaatattaatgcatgtcatttaaaaaccaggggccttcccggccccttttcttagcgacacgacaagatgctcaacaagagcataccatatttaccttaacaacaaaatatatttcgacgacataattgtctcttcgtaaccaggcaacgaaaggctcacaataagcacacttgttcaagaggttaatcatggacggaggatatggctaacggccttgggccgttttacgatttggaacgtgctgcggagtattgtggatacagtacttcgtactttgcaaagctgatcagaaagaaaagcattaaacgatatggaccgtctcaatctcggttcgctcgtgctgatttagatcgctttatggctaatccagatagcttctcatcaacactcgaaatgaaacctagaactcctatcgaacttgaggtgtaacatgtccgttcacatgcggaagaacaacggcacctactacgtcgcctatcgaaacgccgagggcaaccagacgaccaagacattcggcaaggggcgggagggacgcagggcggcccagaaattcgacaagcaggtcaaggaccatggcccggtcccgccgagcacccctgaggccatctccgaagtggtggccgtcgccgacaagatttatctcgaccaactggcccagatatatatcaacacgaggaaggtcgaaggaacaacggtcaaaacccttaacgagatcaggtcgttcctgaagaaacacctgatacccgtcttcgctcaacgacccatcgacgagattcgttacgatgagatattgacgatcgtgggcaaggcctacgccgatcattcccccgtcacgcggggacggtatctgtcctacctgaagaccgtctttcagttcggggtcaaacaggacctcattgaaaagaacccactgcgccactggaagaaagcaaaagagcacccccgtgacaccaagctgaccgtcgctgaccttatgaagatcaaggccgtcgcggccccgcatctggcctgggccatcgaggtcgcctggaacctgggcgtccgcaccggggaatccgaactcttcgccctgaaatgggccgacgtcgactgggcacaatcgaccgtcaaggtcttcgccaccaagacccaatcggcaagggtgatcccgatctcccccgagttcatggcccggctgcgagagatgcagggacgcgccaagaccgaatatttgatcgaatacgccggccggcccgtcaaacagttccggatgtcgttccggtcggcctgcaagcgggctgaaatcccttaccatgtcgtcttgtatgatatcaggcacttgttcgccaccacccttcttcaggaaggcggcgacttatcggcggtgagcaagctcatggggcactcgtcggtgcacatgaccgcgaaccagtattaccacctgctcggtgacgagaagcgtcgcaccatcgccaagttgccgagcttgaacgcctaagagatagttttggcaggggagtgggccatttggtctactccctattttcattatcaaattcaaatttcctgagacttaagatacataaaaaagttttgatcgacatatgggatatgattcataatccaagtcactaaaaaagtaatcacatcaacccgcaaagacatcgaatctaaacgttcgtcaacaataaacctatcgatgctcacaagaaagtcattatgactagaaatgtgttcattaagcatagggtaacccgaagatcgcatcaaagactcttcttcagaaaaatgatacctagcatatctatacaaatcaaccagcaacacacgaagatcaccaaggaaatattctttttctatagaatcctgaagtttattaatgcaaacaaaaagtctctcatgctgactgtctattttgctgtgaccaacagaaaggtagtcatcccactgcgcaattggcatcagcgctcctaaactttagccatacagcccaaattaacgtgcacgcggaaaaattgacacatactctcaccattccggctcaacacttataacaccaaactgagcaacattattcttcccagtaccttttacatcgtacatagccttatccgcacaattcagaagttcatccgacgacatacccaactgatacccagcgaccccaatagacaccgtaaacttaactatttgttctgccagcttcccatttaatcttggtctgaattcataattttgaaccgccaagcgtattgcgtcagaatgaagcaatgcctcatcgacagaaacatcacaaacgacaaccagttcatcccctccatatcgagctgcaaaccatccatacttctcagaatgagcacttattatctttgccaaagtcctcaaaacatcatcgccgacctgatgtccatatgcgtcatttacctgtttaaaattatcaatgtcgagcatcaagacagcaagatgattattatctatctgattttgttcgacagcattacgaagaaaagactcaagataccgacggttatgaaggggagccaaaagggggtcaacattaaccgtttgctcaagaaatcgtgcttttctttcccagtcctttgctttttccttataatgcaataacatgcttttcagtagaactttcagttttggcctcaaagcttcgaggtcatcagcttcggaaagcacctccaatgtctcccgcccgaaggtacttagcaactttccccgctcttgctctgaagacaatgattcgcttatgaactcattaaccaccattgcaagcgatgatgtaatatttttttgagactcaagctcatcttcagcactgacagtaacctggttacttgctataaacatttcaaggtcttcgataatttgatcaaaattattatccgaagaatcttttttagacaatcgactaaatactgttttttgcattgccgatttttgttcatcagtgaatatcgagaaattaccaaccaaattcctgacaaaaagaacaacggcgagccaggatggcttacccccgcatccaatcttgtgcatttcagaacataattttttaatcgcgcaagaatcggtttgacaatcgcttggcatatattccctttaggaacgttttgacattaactctaatctctaacccaatagcaccgccgacacaagtactgcatctggcaataccgaactcaccgagactgccagagttggttgtctcggggaaccccgtgcaatccacttactgcttttcatggaaacattttttttgtattttttgaaatacgcagttactctatattgggtgtgacgtccttcacgatcgccagcaggcgagacagatatggctttgaaatatcaaataatgttgccgttactcatgctccttgccctcctcggcacgtggatgacggttggcaaggtctatgcttcagaaataaaggagaactcaggtcttctggcccagcgatggccgccacccgatgcgtatcccgcgagaccaaaaggtcctcaacccgaccctccaccaagattaggtcaagacgacagaggcaggccacctggcccatggccacataggcccggcatgccaccacctcctcccccgggtcgtggatcgcctgatcgccgaccgcccgaacctccccccagacttgggcaggatggctggagaagaccgccaggaccattgccacagacgcccggcatgccccctccaaacttgggctggggttttcccggatcaccagcatccgaaccaaggcaggacggcaggagaaatgctgttgcgtcagagacagaacaaccggtccagaaacacatcccccccgcagtcattccctctggggaaacaccggaccaacgccgcgacagtgaacagacgtccatgacacatccaaagcccaaccccagcccacagcctgaaacaatggcagaccttaccagaaggttcagcagttcgccaatttttatcgcgactggcctcgctacgggctgcgctgcaactattgtttatttgtatatcatgaattgcaaacgcaagaaccgtcgagaagaaactcttcgtgaagaagctgcacaaacatcttcacacaactttcaagatcgagttaaaatgaatcacgaagaacagatcagaaagaatcttgaggatcaaagcaatgcctatttgcagcgggaagccgctcgacgtcaacgtcaaaagcacaatgaatttcttaatgaatcttggcaacgtgctcaaagaaaacgacaagaaaaaaaagaacgaacggaaacacataaccacaaacagaaaggtaacaaccaacaaaagacctcgagaacggcagaccatcgagacatatcgcatgacaaaaagtgggcgtgttcgattctcggtgtcaatttacgggcctctccaagagaaataaaacgatcatacattaaaatgataaaaaaaacccacccagacaaggcaagctctataaacaaagccacggaagccgagtttctggaaaaagcaaagctcatcaatgttgcctatgatattatgaagaaatgaagtcgcagacgacgagctgtttttcacacgtcgacgaaggtgaacctgggagcctaccagacatcaacgccagcgaggttgagaggacacctcactggcatgctcagtgccaaaatggggaccgtctgcccaaaattttacccgcgcaacacagcctgaccagaaaaacccgcaaatccgggccatctccccagccgcctgcccgtacacgggccaacgtctgcccgaatgttatccaaaattccctcgttatcctgtatggttggccaagatgttatccaacccggttatccacatgataaaaggggccaggccgaaacagacctaaccccttgaattaattctggtgcgcccagcaggattcgaacctgcggccgtctgcttagaagggcgcttcgccaaatgctatcgactgatataattgagcttttttctcgaacgagccccctcccctggataaaatcgatcctgtctgggacatttcaggttctccaaaggttctccaaaatcccggttatccaggtctggagaacctatttcagcgttatccggtagggaaagcagatggacagaggaatattaaatatattagacagataaagccattacccaaaaagtttcaatttgatgtatttgaaacgcaaaacgaagcaagagtggttcattcattaatgttacgaacctacggatcatactagtaccatcatcgttgatatttattcaacaaatggaacaaatgaatatctgttaccaactcgacatgtagtcagacctaaatgtttccattcacaagaaaatatccaaaattaaaccgtgagtcttgttgtctcgttacaggttgataggaattgtccgcaatcctctccccaattttttcgaattgccagcagtacgaccagactctcttgctatttaagccctttaagggcgttacaaaaattattggaaaaattccatactcccagaattcaacggttgtgtatcgtgtccccattgctcgtgctgattttctggggtatactaaattacatgaaaaattagttcccggagtaaatatggccaaagtgcaaaattctggcaagagcaggagagtaggagagcaggagagcaggagagcaggagagcaggagagcaggagagcaggagatttcgacgaaatggacatgcacgtcaagtcacgtgggatccaccaccgcatgagtagacgcagaacggaacaaccgagcgagagaaatctactcgtatggttagtctcggccatggttgttattgccattatcggggtggttgtagttttacaatcgggtgttagaaatcgtcgtctttctgaaaccgctctgccctctggagttgggccagaacagatgcgcctcatcaatacccctttctcagttggtattggttctggccagatgcagctgatcaaacaaaacacaccctttttaggtctttatttgagtgatatgtctccagatttagccgcacagctaagactagccatcaaccgaggagtctatgttaacgacgttgttcctttatccccagcagagacagctgggataaaacctggtgacgtcgtaactcaattggacggaacggacctgatcaagtcgaatgtcgtaggcattgttttgtctaaacatttacccggtgacgttgtacaagcaatcattatacgcaaccaaacacagctcgcaacaaatataagactagaaacaatgcaaaaccagctaaagtcattctaaatacttgcaactattaaacacaaaatcgtttccttcgcgtgcacgtaatcccttaaaacaacaggagatatactaacaataactgccacgatatcaacaaaacaatgaggcttaacacaacaaacttcaaccgttaacaacataccccaaggatttaatactatgacgatcatgttcagagaagacaatacaggcgacaacaaaaagactctacacattgaccttgcagggcatctcgacatattttcgcatgaacaattcaacaactacaaactatacattgacgaatgcaacaaagtagttattaatatgtcaggtcttgaacacctcgacagtagttcacttggattgctcctcatgttgcgagagcgtgcaggtggcacgactgcaaacattgagatcataaattgctcgccttcaatatttaagatattcactgccgtgaaattcaatctcctgttcaacataactccaaaaaatcacacttcataacaatgaacctgacaaactgcatgatggactaacgatcactaaagaacatctttagacacaaacaggaactattatgactacaagcatgacttctgacagtcagccgtgtatgaacaaaaatattcttgtcgttgaagacgataaactctcagccaaccttattgagagttatcttactaaatttggttacgcagttacctgtgcagccgatggcgaatcagcttggaatattctgctgcaagacactacgcgattcaaatgcatcctccttgattatatgctccctgatattgatggcatggaagtcttgcatcgaataaaaaaggctccaggccttagcgaaatacctgttatttttgtaacttcattaaacgatgtagaaactattcaaaacgcgtttgcacatggagcattttcatatctaacaaaaccacttgatataaaattaatgaaaagcatagtccatgctgcaatcgatagatgtaaaatcaacttcgacatcgccaaggacagacaagagtctgaacgatcacttgaacttctcaattcgggaattttccactgcaggacattagatgaagcacaattgcttgcaaagactcttgccatggcatgcccagattctggaaaagtatcatcgggtcttcttgagttgttaataaatgggatagaacatggaatgcttgatattacttacgacgacaaaacaaaactcgtactttcagaatcatggaaagaagaagttaatcgccgactaaagcttaagtgttatcttgacaaaaaagttacagtcttatttgagcgaaaatttggcgagatagtactaacaatcagggatgacggtcctggattcgattgtcaatgctatttagaatttgatccagcacgcgccatgcacccacatgggagaggaatagctatggcttgcatgtttaacctggacaatgttgaattcttaggaaatggcaatactgtccgtgtaacaataagtactggacacaactcccccactctttagcaatgcatttacgagatatatatgaattttaacattactaatttgcgtgaatcgatagagtttctaaacattctcttcgaaaaaattccttcggtcgtcatgctggtcgacaaagatttagtcgtccaagaagttaatgacgcatatcaggttatattcgggctacctcgcgagcaagctgttggtcaacgatgtgggaatgcactcaaatgcgcttttgcagttactgaggaaacattatgcggcgaaacaagcaactgcgagcaatgccttcttcgtcaggcagctattcaaactctcttacaacaagtccctgctgatcaagaaaaacttgttcacactttttttatcaatggctcaagagaggaacgtcattttgaattcagtacccgctacgtcacattccatggcgaacaaatggtgctggtaattctctatgatgttacaaaacttgaagttcaaaaactcgaattaatagacaagcagtctaaaatcgacgaatcacttaaagccgcaggcatagttcagctcagtcttttgcctaagaaactaccacatgttaaaacagtcgacttttcatggaaattcataccatgcgaaggcattggtggtgacattttaaatgtggtacatcttgataaagacaatatcggactttacatgttagacgttgctggacatggtgctccttcagcaatgatatctgtcttggtctatcaactgatgaactcacaaactggcatcctcttagacaatacgacaacaccaccgcttattcgaaagcctgaagaagttttgaacctacttgacaaagagtttcctttgatgcggttcaaaagacacttcactatagtttatgcggtgcttaatcatcgcacaggcaccttaacctatagcaatgcagcacactgttcaccgattgtgttaactcaagatggcgtcatcaagacacttgacgtttccggaacggttatcggcattggtgcgatgccttttgggcaacaaacaattgcactctccccaggcgacaaggtcgtattgtttagtgatggcgtagaagaaatgggtaatgctgataacgaattattcggcagcgaaagacttgcaaacacattaatcgcacttagagacacttcgacggatggcttggtgcaaggcatatataaacaagtcatgcactttgcaggagggcaccctccagttgatgatttaagcatattagcctttgagtacaaaggtacgacgagcagtgtttgacgacaatcaataacccacatcaagatcggtaggtatcaatgactgatcactacagactttaataatttttgtcgaggccataatgataataaaagttagtacaaaaagtttgaaagtcgggatgtacatatcaaatccagggatgagcgaagtctcgaatccaaatgttttcttatctgaaggtgaaatcacaacagatttagttctccaaaaaatcgcaagttcaaactactcagacacctttatcgacacagagaaaggtgtttatttcgcaaagcacaaaaagaaaaaacaggaaatcgaaagcctattttcatcaactgaaaacctcgacaacctcgatccctcagatgcacaaacattcgattgcatccttgaatcaattgattttgcagaaaatcaatacacccagttaatcgaggactgcaaaaaattaattttagctgccaaagaatctgggaacattgacacatcgcctacgtataaacttgtagatcacctcataaacaatgacaaccaaacaaactacgcaatgatgttcctttctaatctcagaggacacgacgaacacacatacactcactgcataaatgtagcattattttcaacaatgtttggaaaatacctttctcttggacccgagaacttaatacatcttgggtttgctggattttatcacgatataggcaaattaaaaatttctgataaaattatcaaaggaacgaaaaaacaatctgcaaaagatttgctcgagttccaaaaacatccactttacagctatgacatgctctcaaaacaatgcacgattccagatgatatcttgcgcgcagtcttagaacatcatgaaaattattctggcactggatacccatgcaagaaacaacgaaatgacatatcaccccaggcctcgctaataagtattgtagacacttttgactcgttaaaatcagaaagatcctaccgcatgtctgtatcaccccacaaagctatttccgctatatttcaatctaaaggagcagcattctctccatctttagtagataagtttgttaaatttattggaatatatccgaacgggtcaattgttgttctaaaaaacaataaaaaagctatcgtcatgtctcaaaacataaagtctttgctgtatccagtggtccgcattgtcctagacgaaaacaatcggcactgtgaaccacaagacatagacttatacgaagccaaggacattgatgacaagcatcatattattgatgttcttgatgctaaggattgcaggttacatatttctgcatacatcaaaacaaaaggtaaatcattaaaactatagttctccactgaattacattggtagattagtagacttttctcagataacttacaactataattcaaactggtacgtgctcagaactgctttaatgccgataagaccaattatatcttgccgattttttttacggaatggcgattgcaaaataacttgaacttgatcgatgtcattgagcaactgaatcagatgtacttcatagcagtatatagcattccagggtcacctaccctcctgccctagaatatcctcacaagttcccacacaccattttaaaagggatgctgtcctgaggtcctgagtgcctcaggatagccctcaggacaaaaaaagtgtaataaaaacattactttatatactacttcctgagatcctgaggattataggggggggttccccaggagtggttttgggggtcggggacggaggtgtttttgaaatcccctttttgggggtaccccctttgattttcgttctaataaaaacgaagggaaacacgtttttctaaaagcaataccagcgccaccttctctagcaatgcgctaaaaaatcaaaaattgcagcttcctgcatcgcataacgtcctgggatatcgctagtttcccttagaaacattccagcccaactcccctgccccgggccagcccatcccctcggacacccctcccctgctctctaccggccccgtcctggggtttttccagttgagccttccttcttggcccgcccgctccccaaaatcgcagggcgaccccgccccggctcaatgcacgttttacaccgccgccccgtgaccggccccgtgacccaggttacctttcccgggtctcatccctagtccacgaggtgaacatgccgaccgacgcaaaaccgcacggcgaggtgccgcttgaaattctgaaggaactcgctcagcggttccggccgatcgagcacctgtttgacgtcatgggcgcggcggatgctggcgtgcagggcgtctttgtgcgccgatgggctgaaattggcacacatctcgcgacaagctttcggaaacacctcgaccagatggtcgcaatagccaggaacgacgattgaagtccttgcaagtcatcaacttaaacggaggaatagaacatgatcgttttggaatttatcgccggaatcgccttgggtgctgttgctggcggcgtcatcaagatgatcacccatggcggcggtgccattgttgggcgaggcaatgttcgaaatgcgatcaacaaagaagagaagaacgtccgtggccggttcaacgacctgagagtcaccaagaatgacccgaagttctacgagtaaccccgaacttctccgaaggagaacttgccatggacgactggccgatcattttcagctacacccgcgcccaagccatcgcagacggcgtcctaatcgacgtcaccgcccaagctgccgaggtgggcttcaaggtgcacacggtggtcaccgaccatctatataatacgtacgtggtgccgccggccggactggaaggcgaagggcagtccattgagggccggcttcacgatctgctctttcgcgccctgctcgcggctaaggctattaaggatagcgaccgcgctgaattcgacgtccttttcctcatggctccggggcggtgggacacggtccatgtggtagcggccatcggcccgggcgaccacggcgagccggtcatgaccatcatgctccccgaagatgactgaaattatagtgggagtgggttgaagcgtcacgcacttattccatacgatttcgagatgaaattactgcgtgacaagaccaagaaaataccgtcaagtggggaagcatgaatgaaataaaatcatatcttacgcaaaagtggaaattaaaaaagtcaaacctcgattttttgagcacaccaacttcaaaacagaggccaaagtgggaaattgcagattttctaaaaaatgcacatcatcaaaactcaatagaaaaagtacctacttttcaagacatcatttaaatccagatttccaaaactaggcaagtctggcaaagaaacatcaaaaaattgttcaacttgatctttgaatattttcaactgatttttagaatgcatttcacaaaattgttctcttattattttttgcaaagcattaacatgcgtagtgtggcaagcaaaactgtcgtgaacagaggcaatacaatgtggagtgttttttcctagacttttgacaaatgaagtgattattttagcggcatgtccagcgtcgagcgaatgtatgtaattaggagaaatactcgagcttgttttcttttttcggagagacatttcttgagtagactcataatctctaaattgaattttgtgcaatttaccatccatatacaagcttatttcgtacactgggaactgatagtaaaaattatgaacaggcacaccggcaggattgttccagcaaagacatttattgttttcgttgaacaaagactggacgcctgttagccagtttttagcttgtgaaaatgcaggacaaatatctttaatagcgtcgtcaatctgcttttcgatcttgcgtgctttttcaagaagtttgatatctttgtcttctatcgagttctcagtagcaagtccaataacttgaaaccaattttttccatatttttgaaccaaggcatcgtgtaagttttttgaagtcactttagatcgcctttctagccctgcgccgtatcctgctgaaattatcgacttcttaatgaaactacgatcaacaaattcagcgacaaatttccttgtaatatcatcgctgaaatcggtagtccctgcagaagaatgcaatttatcgacaacgttttgataaaaatctccaggaatttcgccatcaacaagattgacaaaaggagcagatatatggtcgcgcaagagagcggcataatgctggaaaccattgcaggttccatctacatagacaggaatatttgtatatcgttctccggccttggattgttggatattcttccactcaaaacaaaaagccaaaaaagaatatctatctgatgctttctgccaaaactcgaaatttaaaattgggtcttgagcggatttaaaaatatctctctcattactttcaatccacgaaatcattttttcctttgaaacctttcctgttggcgaaccatactttgaataaccaaacacagcaagattctcaagcgaggcacattcgttgtgtttgtcaatatgttttttctctgaaaaaacaagcaaagaacgaccttcatcgtgactttgggggctaatctgcaaaacagaagaatacatcctcccgcgaaagtcgagataccagggaatataaaaagtccgatctgcgaggtcgtcagccaagcttaaggtttgatcctggagtaatttttttgtcaaattgtttccatatgaagtagatccatgaaagtgcttcatagtgtttagtatttttttattgatattataaggcgtttgctgaagcagattcagcgcttttaaaaacgtcttgtcaaaactgttctttttgtattcagaaataatacatattctttgcttggacgatttgacattaaacgcaaagctatggtcttcttttatcaaatacccgccaccactcaagtcctttttccattcgtctgggctacaaaacattggatactttcgtggcttaaacagactcccttttgttttattagggtcataatattcagcaaatttctcactgaaccctatacgacgcgtgtcgcgaccacgttgcttgccaagtttaattataacatcttgacttgaaataaattcattcaaaaaagtacccggcaatacgctttaagttgttttctataggtgacagtttttcatcaacaggcataatttcgctaattgtttggccagataaaattttgctatcgacaagcattttttttgtttttcgaaaaatttctttagctattcttccaactacgtattgatagctaacgtcagaactgtctttgcttttgttgaggcaaatatcaagagttatcttggttgttataaaaaccaaatatttgcaattactatgcatgaagcgcagcataagttttttgaatttttccttatgcctttcgtctgcgatgccagatccaatatgtttaaatttaacatcgagattcttttttatatgcccagggatgtttttcatggtttcgttgtagaatggtccaagctctttttcccacagcgaagagctagtggttgagttgtgtccattcaaaggattcttttttgcaagagactcgctgaataaattgaaatctatgtcgtttaataacttctctcgctccatttgaatttttctcaggctatcggaagacatcttgacaactcctttctgttttgaatatttttacatgatttcattggcgctagttgaagaaaaaatcaaaaatatcacgctaaataattgcaaggagtgttgtgcttaacaattgagtacaacaaagatctatctttgtcgagcaagtttactgcataaaggacgcattgggctacctccgctctagatggcagtgatgacatggtttggcggtattgattccggcgaccaatccactgagcctgtgatttcgggtcagacaatttgcaaacaagtggtggcccagcccctcggcgtgccgtggccggtcttaactcacatcagcaatcacaattgaccgaaaactgccacgaggagcagatagcgtttcaggatgttctcctgtccctaaatccaaacctacaaacccgatgcatgctgagcggcgacggtccagggtgcgctcgaagctgagctcaacgagtcctgtcccgtccgccatcttccagcgacttgccacccctaggcaatatccgggtgcagttgttgtacacggcgcgccgagcgtcatgtctccacgtcgggaattcagcccgttgcgcatagtatcgacgagattttttctccacgtctccccaccgtataggcttttgaggacatctcgggagaaatgacccttgaccgcgacctagttagccggggcgtccggacagggcggtgttgtggcgtgaccctgcccaggcattaccagcggcctcctcctgcgtcttgggcagagctaaggtgccgcccttgttagcctcgtgaaccgcgacgcgacggcgacaactacgccggtgtctgtccacgcgtgctcgcgcccccgtgtcggcctgatctgacccgctagaggtcctttgcaatttactcagatcgtccgcagatggctagaattttgggttttatgcttttgatattttcaactacttgtttttattgtactaattttttcatccgggggactaatagaaagactgtccatcgcgaaaaatctgcgaaaaggccggtaacaccgagcccattcacaatgctctgcacaagattttggcagagccttgcaaattgattgatttattcaattaattgcaaggctctgctttttttttgcaagcaaccttgattaatacattcaataatcaaacgtaaatgaggagatgtctcatgtcaaataaactccggaccatcacgccggaccagttgaaagaaatggccatcgatttcatcaacaatcacaagtcaagcgatggcacgactattggagtagacattaaagacatgtgttcgcatttctctgtttcaaaatctattgcgagggatgttttcattgaagcagtcaatcttggtcttcggaacgtcaagctcgacgctcagaaaacaaagaagccgagtagcgaaaatggatgcatcaacgccaaaggtgtatacattatcactaagaaagtatttaccgaattcaacaatagtctcgaggacgaaagaaaattcaagatcaacgacaagtttaacctcactctcgacggcgaaaaaattgttctggaaagagtcgaggatgagtcttaaaaaattcaaagctgcgattgccgaggagcataagaacaattggcagctaatttagcctacgtggcgtggcttttgtctgttgttaaaagccacgccgcatctgacattttctgcactcattttgtacataaacctacaattatacattaggataatatttctgcattcattatgcaggctgcaaacaacgacgtaagtcaatcgccggggttggtaagctgcgttacttctccaattctgttaaattattaaattagtatttttaatcgaagcgagaagaataatgtcatgcagttacccggcaatcagtatagttccgtcggagtttttacgcattgtttggaaagattttgcgcaaaaagcaattcaaaacatttgcacattaaacagtaacgcaacttacaattttgagttgccaacagaacttaaccttatcgattcaacggttaaatcacttattgcaaaaggaagcaatgtctactttcaggttggcctgcagtcacacaagtcggggccgcataaacgaggcaaagaagttacgaccgtggctatccctggattttgggacgatacggacattttgggccctgggcataaacaacaacgcttaccgaaagaccaggacgcggcgttggaacttatcttcgacttccctctccacccgaccctgattgtgcattctggcgggggactatacccgttctggcttttcaagaacccctgggtctttacctctgacgctgaccgagaagcggccaaggacctttcgaagcagttccagactgcactgcatgacaggggcagacggcgtgggtacgagttggactccacgtcaaaccttgaccgtttgcttcgaattccggggtcggtgaacttcaagatgcccgagacccctcgtcccgtgcatgtgctctacttcgacccgaacaagcgttacaccctggacgagataaaggatcacctgccggcgaaggctatcgctgtcgtcgcgccgccagcccaaaaggggacgagcatcccctcgggtgagaggaaataccccccggccgatctgaacaaaatcgtccaaggatgtgcatggatgcgtcacattcgtgacgatgccacggccttaaccgagcctgaatggtatgcgggcatatcgatcttatcaagatgccaagccggtcgttctataacccatcaatggagcaagccttaccaaggatacaaacaagaagaaacggacaagaagtttgacgatgctcttaacaatgcaggtcctcgaacgtgcgaaaacatcaggcaaagctgcggcggcgaagcatattgtagtaaatgttcgtcgtggggcaaggtcaaaagtccagcaatcctcggcaaatctcaagcgttcataaaagagtatgtcgcagacagtttgcctggggctccagtatcgcaaggtattgtcataccggaaggatacgtcgttagcttagagcatggagttgaacgtattgagatgcgaggcaagggagatgccaaattcgaagtaagaacaaagatccttatcacacctcttgtcatatctaagcgtcttgtagatgtgaacaatggcgaggagtccattgaaattgcgtggcttcgcgatgaggtgtggaaacctcggatagaatctcgttctacgatctttaacgcaagggagatcatgagcgtcgcaggacaaggcctccctgtcaattcgaatacggcatctttagttgttgcatatctagcagactttgagcaagcaaacagggatatcatacctgttgtgtctgtcacgtccgtattaggatggcagaaaggcatgaaaacctttctttggggtaagcaggtccttgcgtcgccaggatcgaacaaccatgtcgtgttcaaagcgcaagaggatggcgatgatcagattgcctctgggttttactctaaaggatcataccaagcatgggtcaaaataatcaacagcttgtatgaccatgaacgatcgataatgatggtctacgcttcgttcatctctcctttcttgaaaataatcgaggcaaacaacttcgttgtagaccttgcattttcaagctctaaaggaaagtcaatagccttgcgttgttccgcatccgcttggggcgacccttctggaactggaaatacggtgttcttcacctggaagacatccgaagcatggattggtcaaactgccacgcttgtcaccgaccatccgttaattcttgatgaaacaaagcttgccggaacagccggcaagaaaggagaagctgccagcaaggtaagttcaacgatttatcaggtatcaagcggacaagacaaaagaaggggttcacttaaaggaacaaggagaaccggcacttggcgtttggtccttttgtcaaccggggaacaacgtgccgttgatttctgcaaggaagacggcggtgcccatgctcgcgtcttaagtctttggggaatgccattctcgggcgacaacctcgcggactacgtcaacaatgtagaactcacggtcaaagaaaacttcggtcatgccggccccaaggtggtcaagttcatcctcgcgaaccaacgcgattggccgctgtggcgcgagacctatctggagcttcgccgacattacaccaaacttgccggcggcaataacatcgcggcgcggctcaacgaccaactcgccgtcctcaacacggtgatccctttggtccacgccgccctgcccgagttgaagcccaagcggcctatcagggagtaccttgatgccatctggaacacggtcagcaagaatgccatggaagcagacagagcgaccgttgccttacggcatgtatatgactggtcggttgcaaacagagacaagttcttcgatggcaagtctcaagacagcaaccagcactatgttccgtctatgggatgggctggacgatgggacaatggcaaatggagtgagatagcttacctcaaaccccagttaacaaagatcattgaggagtccgtcggcgaacccgatgcgattatcagaacgtgggctgaccgagactggctctacaaagacaggcaaggtcgaaaccaacgacaactgacgatccgtggacagaaggcttgggtttactgccttaagaaggcaaccatcgagacggaacttggcatcaagttcgacgatgatgcaacatggaataccaagaatttcaaaccaacattttaaacaggagcgaggaagaaaggggcatcctgcggccctgagggccgcaggacagccctgcaggatgtttttatacaataaaaacggttgtttatgtgcaatttcctgggagtcctgaggattttagtgggtgtggtcgaaggggaacccaaacgcactttccctcgtttggtcccctctcaaaaggggctacccttgttttacgcagtcccgcaggaattcaagaaaaatttaataacatactgaaaaatatttatttttttctaaactgcgtcctgaggccctcaggatttttcaggactgcctaaaaagaatgcaaaaccggaggacaatgtgagtcatttcgacgagatgcttgatcggtacggtttgtcccatgatgtcttcggcctttacgaaagtcaaaatccgccgccgtcggaaacgcaggacggcgcggcagaacaccttcctgtcgaaccgattgaaattgagatggcacccggcatgggaacatatggcacgccaccacctgacggttccttcgccgacggaccagacaattccgagaaacttccatgggaaagcgaggaagaaccttcaactttcgaaaggattcccattttctccgttgactatgacgggttcgattaaaccacattaactgcatcggcctggcatgggcaagatcgtttcctgtcccatgccaggatcaagctgtttaaggaacatcggattggctgactatctgaataaccacgaccatccgaagtaatgttatgacaaaacacttaagactatactcgctagtgaactcttgtttttatcgctagacagatatatgctttttatttttcgcgaggcaaatagagaaattaccaatatatatttttgaacttcaaaacttgatatcaagcaaaataattataaccatatttttcaggattaaagacatacattggttcaagataacaattttcagacattgcagatacaattgtcatgggagccttgctaggtcttcgttctagcgttcaattcgaaccatatatactatatgaggtcaaaaaataaattgtctcgtgatatacttcaaacatcgttctcatcgaatgcttttgaactcgagattatctagctgacatatcgcaagatagccagtggaggagatgaggccttaaaccagccggtaatacttacttcagtatgaaaccaaggtggcgcatatggcgaacgagattcatggcaaatcgaagttcaatttacaaccaccatatgtatgcgattaggtgtcggatggttttgttctagatttgactaaaccaagggaagtccatttgcaatcgttcaaccgtaaggttagtgagaaaaccgaagttgccaatggatggctgcgcatctgtaagggatgcagagagatgttgatccataaacttactgaaaatattgtcttgatgaaaatgcttgaattcattccaatgaacagtttgcgcgaaaattacaacaacttcttgtcaagctatgactatacttcagaaatataccttaactatatcaacatctctcggaaagcctgatgcgggaaaaccgcccgtcaggaattcatggacgcttagaacggcgacgttcttctcgatccaagaagaacacttcttgccagcggcataactttgcttgctggtggaagtgttctatctgcaatagctaccacgaaggcctagagttctaggccttcatttttacgcaataattttgaataccatggccaattcgttggtataaaaaatataccgctctaaaatcccatttactgcgcttttcccagatttccacagccagttcccactccacggcgaaaacctcgggaatcgccgtatagggccaatgccagtttttacccggcgaaaagtcgattttccgctcatattttcgattccaatagagaaatataccaataaacaaaggagatttccatgtcaaagaaagctggtcaggcaacaaacgacggagaaggaccttctgaaaagaagaaggtcgaacccaaatacaatccttccattttgcgcgaatgcatccaaaaaaacatggatgccatcagcatcatggaaaagctcggcatcacccatcgacaaactttgaagcactgcgtgctgaagttgatgagtgacgacaagacctactatgaggtcaaaggattgtatctcaagaactcaagtcgccctcgggtgaacaaaaagatggagcttaaaatccatctgaagaatcttgatcttcgagaactcgccgtggctgaaggggacgagtttactgtcatggtcgaaaatgaaatgatcatattgaccaaagtttgactactacaatctccatcgatgaaagccacacctccgggtgtggttttttatttatgcgaacatcctttctctcaaacttcgctgtattatagagaaattatccatatagccaatgtacgtttctacataaaaacgtactttccccggcaaaaacctgattcggcgttagaatttaaccagttacaggctgcttgggagtcctagtcctgggagctggctttttagaagtccgacttcgcccacctaaactgcaataattgcattggagtaaaagatgaaggtcgaaccaattactgaaccaaagtccattaagagcatcaagaaaatcctttctgacaaccatcgagacaaattactgttcatcatgggcatcaacactgggcttcgcgtgcaggacttacttgcgcttaaaaagaaggacgtcaaagacgtccaagctggagagcgagtaatcttacgcgagaagaagactggcaaggaaaacgtcttcattattaacaaggagatcaagactgcccttgacgagcatctatcaacagcaaagctagaagacaaccactacttattcaaaagtagaaaaggttcgaactatccgctttcgacatatgccgtcaccaagtacgtcaaagcatgggctgaagctgtgaatctcaaaggaaactacggagcccataccttgcgcaaaacctggtgctaccaccagcgcaagaccttcggtgtctcctgggaagttttggcgaagcggctgaaccattccagcccgtcgattacgcgccggtaccttggcatccaagaggaggaggtagaggagattttgctcaacacaatctaatcaatacaggggcttattaggcccctgtatcaattaacactgttgcgcagaagaccaaacaacacttcaaagcataacgacgataaatctatcattaacgactaaacattaatttatgctttcttatctggagaagcaatcatggacggaggagatgactagttgtcttgggccattctacgatttaaaacatgctgcgaagtattgtggatacagcacttcatacttcgcaaagttaattaaaaagaaaagcattaaacgatatggaccgtctcaatcgcggtttgctcgtgctgatttagatcgattaatggccaatccagaaagtttctcatctagtctcgaaattaaacctagaactcctatcgaacttgaggtgtaacatgtccgttcatatgcggaaaaacaacggcacctactacgttgcctaccggaatgccgagggcaagcagacgaccaaaaccttcggcaagggccgggagggacgcagggcggcccagaaattcgacaagcaggtcaaggaccacggcccggtcccgccgagcacccctgaggccatctccgaagtggtggccgtcgccgacaagatttatctcgaccaactggcccagatgtatatcaacacgaggaaggtcgaaggaacaacggtcaaaacccttaatgagatcaggtcgttcctgaagaaacacctgatacccgtcttcgctcaacgacccatcgacgagattcgttacgatgagatattgacgatcgtgggcaaggcctacgccgatcattcccccgtcacgcggggaaggtatctgtcctacctgaagaccgtctttcagttcggggtcaaacaggacctcatcgaaaagaacccgctgcgccactggaagaaagcaaaagagcacccccgtgacaccaagctgaccgtcgctgaccttatgaagatcaaggccgtcgcggccccgcatctggcctgggccatcgagatcgcctggaacctgggcgtccgcaccggggaatccgaactcttcgccctgaaatgggccgacgtcgactgggcacaatcgaccgtcaaggtcttcgccaccaaaaccaaatcggcaagggtgatcccgatctctcccgagttcatggctcggctgaaggaaatgcagggacgcgccaagaccgaatatttgatcgaatacgccggccggcccgtcaaacagttccggatgtcgttccggtcagcctgcaagcgggctgaaatcccttaccacgtggtcctctatgacatccgccatctgttagccaccaccctccttcaggaaggcggcgacttatcggcggtgagcaagcttatggggcactcgtcggtgcacatgactgcgaaccagtattaccacctgctcggtgacgagaagcgtcgcaccatcgccaagttgccgagcttgaacgcctaacagattgttttgacaggggagtgggccatttggtctactccctattttcattatcaaattcaaatttcctgagacttaaggtacataaaaaagttttgatcgacatatgggatatgattcataatccaagtcactaaaaaagtaatcacatcaacccgcaaagacatcgaatctaagcgttcgtcaacaataaacctatcgatgctcacaagaaagtcattatgactagaaatgtgttcattaagcatggggtaaccagaagatcgcatcaaagactcttcttcagaaaaatgatacctagcatatctatacaaatcaaccagcaacacacgaatatcaccaaggacatattttttttctatagaatcctgaagtttattaatgtaaacaaaaagtctctcatgctgactgtctatcttgctgtgaccaacagaaaggtagtcatcccactgcgcaattggcatcagcgctcctaaactttagccatacagcccaaattaacgtgcacacggaaaaattgacacatcctctcaccattccggctcaacatttataacgccaaactgagcaacattattctttccagtaccttttacatcgtacatagccttatctgcacaattcaaaagttcatccgacgacatacccaactgatacccagcgaccccaatagacaccgtaaatcgaatcgatccatctgccagctttccgttaatccttggcttgaattcataattttgaacagccaaacgtattgcatcagaatgcagtaatgcttcatcaacagaaacagcacacacaacaaccagttcgtctccaccataccgagcggcaaaccacccatatttttcagaatgcgcactgataattttcgctaaagtcctcaagacatcgtcaccaacttgatgaccatatgtgtcattgacttctttaaaattatcaatatcaagcattaagacagaaagaggactattatcaacttgattttgttctatagcagtccgaaggtaagactcaagataccgacgattatgaagtggagccaaaagcgggtcaacatttactgtttgttcaagaaagcgtgccctcctttcccactccttggctttttccttataatgcaccagcatgcttttcagcagaactttcagctttggcctcaaagcttcgaggtcatcagcttcggaaagcacttccaatgtctcccgcccgaaagcgttcagcaattttccgcgctcttgttctgaagacaacgactcacttataaattcattaacaaccatggccaatgaggaggtaacctttatctgggactcaagttcctcttccgcagcgacagtggcctggttgcttgctataaacacctcaagatcatcaatgatctgctcaaatttgccatccaaagaaccattattcgccaatctaccaaagacgcttctttgcatagctgacttttgttcatccgtaaatatagaaaagttactaaccaagtttctaacaaaaagaacaactgctagccaggacaggtcattaccacatccaattttatgcatttcggaacaaatttttttaatagcgcaagaatcgctttgacaatctgtcgacatatagtccccttgataacgcccaacatctactatccattttagatcaatcgcaccaccagcacaagtacagcctctaaaaaaaatggtatcctcaaatctgtcgactggtcgcttcgggcttcaggagaaatgaggccatctgcctaaaatttaatccgctcaccacagcccgatcagaaaaactcgtaattccgggccatctaccccgccgtctgcccgtacacgggccaacgtctgcccgaatgttatccaaaattacctcgttatcctgtagggttggccaagatgttatccagcccggttatccacaagataaaaggggccaggccaaacatgacctaaccccttgaattaattctggtgcgcccacagggactcgaaccccggaccgtctgcttagaaggcagatgctctatccgactgagctacgggcgcgcggcacgaaaactaaacaagccgccccctccggtcaaggccggccttgacgaaaggctccttgcggctcacactggcaaatcccgggacattgcccgccataaggagactggcatgaagctgcgcgtgctcggatgctccggctcggacctgccggggcacaacctcacctcgttttgcgtcaacgacaccatcctcctcgacgccggctccgtcacctcctccctggacctcgccgctcaggccaggctcgaacatattttcgtcagccacagccacctcgaccatatcaaggacatcctgtttctggccgacaacctcatcgagttcttcgtcgccggcagccgcgccccagtggccatccacggcttgcccgaagtcctcgacgccatatccacacaccttttaaacgacaccatctggcccgacttcaccgtcatccccacggattcgccggtgttgacctacgcccccatgatcccgggcgtgccggtcgtcattggcgatctcagcgtcgccgcctatcccgtcaaccacgccaaggccgcctcgggcttcgtcctgtggcaggacggcggcacgcgaaacctcgcctacaccggcgacaccggcccctgcgacgacttctggaaggccatggacgccctgccctttgcgcttacaaacctgatcaccgaggcctccttcccctcttccatggaagccctggccacggcctccaagcacctgaccccgaagctcctgcgcgccgaactcgacaaactgcgcgcccggccggacatcttcatctaccacttaaaggccccgttcgccgacgtcatcgtggacgaactggcccgtgaactggccggctaccactaccggctcctgcgagaacatgactgcatcgacatctgattttcccgatttcgccgcctttgcggcctatctcgactccctcggcctttttcacatggacctcggccccgggcggatgcgcgcggccctggccgggcttcgcctggaaagcctgccccatctggccgcccaggtggtcggcaccaacggcaagggttccacggccgccttgctggccggcctgctcgccgcccacggcctgcctacggggctgtatctgtcgccccatttcgtgagcgtgcgcgagcgcatcctcctgggcggcaagatgatctccgaagaggattggacccgggcggcaagcgccgtccaggccgccgtggccggacgcggcctggacggccgactcacctattttgaacttttaaccgccatggccgcctggctcttcgccgatctcggggccgaggccgccgtctatgaagccggcctgggcggggccggcgacgccaccacggcgctgccccgcgacctgacgctcttcacacccatgggcctggaccacgcctcggtcatcgggccgacactcgccgacatcgccctcgacaaggccggagcgcttattcccagcggccaggccgtcaccggtccccagccggccgaggccgccgccgtgctgcgccgcgaggcgctggctcgcggcacgcggcttttcgacgcagccgaactggccgcctacgatccgtcgtcgcgccaggccacgctccttttccccaaacgcctggacgtcccggacgtgaagctgaaactcgctgggccgcaccaagcccaaaacgccgccctggccctggccggcttcgccctgtgcgccgaggccatgggcatcgccccggactccgaggccgtgcgccgcgccctggccgagaccttcctgcccggacggctccatctactgcgtttgccgggcatggctccggcgttgctgctggacagcgcccacaacctgccggcccttaccgccctggagactgccctcaaggccctgctcgtctcgcccacggcgcttatcttcacctgcctggccgacaaggacttcgaggccatggcgtcgatggccgcccggctgaccaccggccccatctacgtgcccgagctgccgggcgtgtcccgggcccgaccggcggccgaagtcgccgcccgcctgggcaagcgcgccatggccgtggccggtccgcgcgaggcgctggaagccgtggaaaagctcgacggcacggtgcttgtctgcggctccatgtacctcttggccgcgctgttcgccgaccgcccaaattgatctcggccccgattccgggtattggtcgcgccttgacgcctcgccaacgccaacccttcgggatcgccgtgcaaaatcttttccgtctgctcccgcccgtggatgctgttctgaccgccctcggcgatgacgtaggcttggccgcgctgccccgggccatgctgcgcgacgccgtcacggcctacctcgacgggctgcgcgacgacatccgcgccggccgcctgaccgaaccggcccagctcgaccacggcctcgttttcgcccagtgcgcccggcaggtcgccgccgccacccggccgcatttccggcgtgtgataaacgccaccggcgtggtggtgcacaccaacctcggccgctcgcttttagcccccgaggccgccgccgccgccgctgacgcctgcctgcgctactccaacctggagttcgatctggccaccggcgagcgcggcagccgctacagccacgtggtcgacatcctgcgcaccctgaccggggccgaggacgcgctggtcgtcaacaacaacgccgccgccgtcatgatcgtcctggaaaccctggccaagggccgtgaagtcatcgtctcccggggccagctcgtggagatcggcggttcgtttcgcattcccgaggtcatggccaagtccggggccgtgctgcgcgaggtcggagccaccaaccgcacgcatttgcgcgactacgagaacgccgtcagcccggaaaccgccgcgctgctcaaggtccacacctccaactaccgcatcgtcgggttcaccaaggaagtctccctggccgaactggccgaactgggcgcgcgcctgggactcccggtcatcgaggacctcggcagcggcaatttgaccgatttcgcggcctgcggcctgcccggcgaaccgacggtgcagcaggccgtggccgagggcgcggacgtggtcacctttagcggcgacaaggtgctgggcggcccccaagccggcatcatcgtcggcaaggccaagtatatcgccgccatccgcaaaaatcccctcaaccgggccatgcgcatcgacaagatgacgctggccgccctggaagccacgctgcgcctctaccgcgaccccgagcgcgcccgggccgtcatcccgaccctggccatgatcacggcctcccccgaggcgcttgccaaaaaagcccgcaagctggctgggctgctgcgaaaggccctggccgggcgctacgcggtttcggccatccccggcgcttcccgggtgggcggcggggcctatcccgaacgcgatctgccgaccaccctggtggcattgcgtccactcacaggcgcgccctcgcccgacgccctgcgccagcgcctgttggccgccgatccgcccctggtggcccgcacccaggacgacgccctgctgctcgacccccggacgctcgccgacgacgaactgaagcttgtggccacggtgctggcccaggcctgccagccagaaaccgcctagcgccgctgcccgtaaaatcccgctcatcccaaaagacaaggctcccgccggtcgccatgaccggcgggagcctttttcgcccggatctcgacgccgcaagccgcgccggcctgggacggtcgcgcctcggagcttggccgctgcctcgggcgcaaggaacacgctgaacgctaaatgtaggcccgcgaaggcggcgaactgggaagcgtaccggcgcgaagcgcctccaccacgtcggcgatggccgccaccaccccctcgacgtcgccggccagattgcaaatcgacggcgacacgcgcagcaagtcctgccccatgacccgcagataggcgatggcgaaacggtgtttggcgtagacatgctgcatgacgtcgccggccgccacgccttcgggagtacggaacagatagaccgcgcttcgcagggcgtcgttggtcgtcggcgtgacgatgtgccgccaggccgcgtcctcccggaaatccgggaacatccggggcagatgccggaacagggcgtttttgagccgcgtgcccagggcatgggtccgggcctcgacgcgctttggcgtcacgccgggatggaagtggccggtgtggaacagcgccgtcatccaggccgccaccaaggtgacgtcgttttgttggcccaggtaggaaaagcgcctggccgtggcgtcgatgccgccgctttcgggcgcgaaaccgtaatgggccggggtgttgatgtgctcgtcgtagccccaggcgcccggcgcgaagcgttcggccgcgcccgtggccgggttcatgtagatgacgccgaccatgcgggggccgcagggccatttgtggaaactgccggcgatgctgtccacgccggtttcctcaaggcgcatgtccagcacgccaaaggcctgggcgctgtcggcgtggatgtggatgtccttgtttacggcccgcagttcctcgacgatgcgccgcatgggcaggaccaggccgctttcgttggactgccaggagaggctgacgaccttggtgttgcggtccaccagccgcaaaagcgcggcgacgatctcgtcctcgccggccgggtccgagggcacgaccccggcccgggcctcgtcgacggaaacggtctgcgcaaacagcttcgtgcgcatgatccgcaccgaatccggcccccagccctgggtcgccttgcggtagagccaggcttcgtggttggtcgggtggttgacgtcccagaccacgacgttgtcccgggcaggattgaaaaagcccgaggcgaccaggccgttgttgatgcagttgttggcctgggtggcgttggctgtcagcgcaagcaaggcattggccggcgcgtccagcccgccaaggccgatccaggtcttgaccgcgtccaggccgtgcacgaggccggcctcggccagctcgccccgcagcgcaaaggaaatgtccacttccatgagccggcgcacgagttcccccatggccgaaaccggcgtcagcgccggacacatgttggcggcgttgacggaaatgcagccaaaggcgtcgcggtcgaaatagcgccgcaccaaggcttcccactgggcctcgtcgtccggggccagggcgtggccggcaaagggacggccctccccgcgccacaaggcgatggccgcgaaaatgcgctccagggcggaaccgggcggggcttttttccaggctccgtcagtggcaagggccgcgccgagatcgtcgcgccagataaaatcgctcatcgacaactctctccccgcctcgccgccaacacattggcccaaggcgacaacaatcgggccatggcccgtttattcatcaatatgcccggccgagccggccgggggtccgtccatagccccttggaccaccgccggcaagggggaagccgccgcaacggcgctttccgtccaagcccccctttaccccttttcccgtcgagggggtccgggggggatcatcccccccggccgccggaggcatcctacacgcaccgcccgggcggcgaaccccgcgccaaagggggttccctcgccgggccgagatgcttatgatcagcgttcgtacgatcatggaggaacccgcgcatcatgaccaacgacaccaccaaggcggatagccaaccctctttcgccattgaagctaaaagctgctgggagacctacgcctcccccgaagtccgccaggacatgcaggccctggccgagggctacgtgtcctttctcaccgcctgcaagaccgaacgcgaaaccgtgcacttcgtgcgcgaggtcctgaccaaggccggattcgccgaatgcgacgacgaattcagcggcgacgccgtttttcgcgtcatgaagggcaagaccgtctttgtggcccgcaagggcaaaaagcccctgcgcgagggcttccgcctggttggcgcccactgcgacacgccgcgcatcgacctcaagcagcgcccgctctatcaggactgcggcgtggcccagctcaagacccactattacggtggcatccgcaagcaccagtggctggcccggccgctggccctgcacggcgtggtggccaaaaaagacggcacggtggtgccggtgaccattggtgaggacgccgccgatccggtcttcgccatccccgaccttttgccgcacctggcctaccggcaggtggaaaaaaagctgtccgaagcctttgaggcggaaaagctcaacatcctcatcggccattccccggccgacaagcccgaacaggccgaaggcgaggacgccgagaaacccgccaagaacggcaacgaggccatcaaggccaaggtgctggaacttttaaacgccaagtacggcatcgccgagcccgacctctacagcgccgagctgcaggccgtgccggccgggccggcccgcttcgtcggcctggacggggcgctggtcggcggctacggccaggacgaccgggtctgcgtctatacggccctgtcggcacttctcgacgctccccagcccgagcacacccagatcgtgcttttttgggacaaggaagagatcggctccgaaggctccaccggggccaagtcgcgctttttcgaatattgcctggaagatttgatcgacgcctgggacgcgggcgcgcgcaagagccgggtgctggctgccggcaaggccgtttcggccgatgtccacgccgccctggacccggattatcaagacctccacgagaagctcaattcggcgcttttgggctttggcccgtgcttttgcaaatttactggtcaccggggcaaggtcggggccaacgacgcccaccccgagtacgtggcctggctgcgtaacctcctggaccaggccggcatcccctggcagatggcggaactgggccgggtggacctcggcggcggcggcacggtggccaagttcctggccgtctacggcatggacatcatcgatttcggcccggccgtgctcagtatgcacagcccgttcgagatcaccagcgtggccgacatctacgccagcaaactggcctacaaggccttcctgtcgagctaacggcaacgccccttaccccatgttgggggtccgggggcctaaggcccccggcggagaggtccaggagaggcagcgcctctcctggccgccggaggcatcttcatcttcttcttacgctcacaaggacgcgcacatgccagtgatcatggggacggccgggcatatcgaccatggcaagacgacgctcgtcaaggctttgaccggcatcgactgcgaccgtctggccgaggagaagaagcgcggcatcaccattgagctgggctttgccttcatggacctgcccggcggcgcgcgccttggcgtggtggacgtgcccggccatgagcggtttgtcaaaaacatggtggccggcgcggccggcatcgatttcgtgacgctggtcatcgccgccgacgagggcgtcatgccccagacccgcgagcacctggacatctgcacgctgctaggcgtgtccacgggcttggtagccctgaccaaatgcgacatggtggacccggactggctggccatggtcaccgacgacgtgcgcgccgagctggccggcacgttcctggccgatgcccccatctttccggtctcgtcccacaccggccagggcttgccggagctgcgccaggccctgtccgatctggtggccgcctttgcccccaagcgccgctcggatctggcccggctgcccatcgaccgcgtgttcaccctgcgcggccatggcaccgtggtcacgggcacgctcattgccggatcgtttaaaatcggcgacgacgtgcgtctttttccgacagacaaacgctccaaggtccgggggctgcagtcccacggcgaatccgtggaggtttcgccggccggccggcgcacggccgtcaatctggccggcctggaagtcgaggacatcgaacgcggcgaagtgctggccctgccggggacgctttttccggacaccatatgggaagccgaagtccactgcctggcctcgtcgccgcgcgggctcaagcaccgcaccgaagtgcatctgcaccacggcacccgggaaatcctggcccgcatccatctcctcgaccgcgacaagctcgaacccggccagacggccgtgtgccagctgcgcctgcccgagcccctggccggcgtccacggcgaccgggtggtcatccgctcgggcgcgccgcttcgcaccgtggccggcggccgggtcgtcacgcccatggcctatcgcatcaagcgcaacaccgaggccaccaccgcccttttggccgaactggccgcagcctccggggcggggctggtcgccctgcaactgcgccgggccggaccggacggcctggggttcgcccggctcatgaccttgtccgacctggaatccaaggccctggaaaaggccctgggggcgctttgcgacaagggcggcgcggccctggtcgaccgcgaaggcaaggaaggccgccactacgttcacggcgacaccgtggccgaactggcggccacgctcaccgacttcgtcgccgccttccacaaacgcgaacccctcaagctcggcgtgtcgcgcagcgagctggcctccacctggggcaagaagctcacccccaaactgttccacttcatggtcgaacgcctgctgcgcgccggcaaactggccaacgaaggcgacgtcatccgcctgcccggccacaaggtctccctggcctcggaccaggccaagctgcgcggcatcctgcttgacgcctacgtcaagggcggcctgaccccgcccaacgtcaaggatatcctcgaacccctggacctcactttcaaagaagcccagccggtctacaaggtgctccaggacgaaggacgcatcgtcaaggcccaggaaggcatgtacttctgcgccgaggcgataaaggcgctcatcgaaaaggtgcaggcctactacgccgccggagccgtggacatggggccggcggaatttcgcgaactgaccggcctgtcacgcaagttcctcatcgcgctgctcgaatacctggacaaggaaaaggtgactgtccgcgtcggcgacaagcggcagttgcgtaagcggtgagaagtaaagaggaagatgcctccggcggccaaaggggctgagcccctttggaaaccccgcatggggaaaatacgagcgcctgttggcgcgcggcttcgcgcgcgccaacaggcgctatggttttccaggtcgggggtccggggggctgagccccccggccgccggaggcatcttcctgccttatctaaaaaataaagttcagctttttcttgagcgcgtccagattccgcgaagcccgggcgcgggctttggcgttgccggcttcgaggatgtcccagacgagcttggggtctttgtcaaaggccttgcgccggtcgcggacgggttcgaggaaggcgttcatggattcgacgaggagctttttgcagtcgccgcagccccaggtggcgtgggtgcagccgtcgacgatttcggggagcctggccgggtcggtgagcagctcatggtaggggaagaggttgcattccttgggatcgccgggatcggtcaggcgagcgcgcttttcgcaggtgagcatgctcatgactttcttcttcatagccccgggctcttcggacaggccaatggcgttgccgtagcttttgctcatcttgcggccgtcgaggccgggcagcttggagtccggggtgagcatggcttggggttcggggaagaagttgccgtagaggtggttggcccggcgggcaatttcccgggtgagttccaggtggggcagctggtcgaggcccacgggcacgaacccgggcttgtagagcaggatgtccgaggccatgagcacggggtagcccaaaaagccgtaggtgttgagttccttggcggccagctcctggagctggtccttgtaggtggggcagcgttccagccaggagaccggggtgaccatggacagcagcagatgcagctcggcgtgttccttgacctgggactgctggaacagcacggatttttcgggatcaaggccggcggccacccagtccttgacgagttcgggaacaaagcccttgatgcgcttgggatcggcgtattcggtggtgagcgcgtgccagtcggcgacaaagaagaagcactcgtggctgtcctggatgttgacccagttcttgagcacgccgaagtagtggccgaggtggagcgcgccggtggggcgcatgccggagacgatgcgtttgttttccttgggggcgttgtcgctcatgggcttgtgttccgttttcgtcgtggagggtatcgggtgaaggcggccggggccgcggccttacagcaggatttgggtgaagtagcgcaccggcggtaagatgatgcggccaaggatgccggtgacggccaaaagcagcagcgcgaaaaatccccagcgaccgaggtccatgtagcgcagggcaagccgcggcggcaggaaggcggccaggacgttgctgccgtccagcggcggcacggggatcaggttgaacacggccagggccaggttgacctgcaccccggcggcgcagatgtaggccagaggttcgaggatgctgtaggcggcggagccttggagcgtgcccatggcggcgtattcgaccatgcggatggccatggcgaagaagatggccaacagcacgttcatggccggtccggccagggccacgagcatcatgcccttggccgggtcgcggaaatagcgcgggtccacgggcacgggcttggcccagccgatcatgcgggtgagcaggaaggccaacgcgccgaagaggtcgagatgtttgatggggttgaacgtcagacggccggccagtcgggcggttgggtcgccaagccagttggccacgtagccatgggccacttcgtggaaggtgacgcccatgaggaccgggacgaggagcagcgcgatttcttgaatggcgcgcgaaatatcgggaaacatgggcatggcggctagcacgaacgccgccccggggcaagggcaatcgcccggacggcggcaggcgctccacggccgccgcagggcatgtccggtcaagtcggcctcggccgatacgtttggcgttttcgagaaagacgagaaggcatgattacagaaaaacagatattggcacgagcaacgaagggaggggcgtgcccttggacgagggcaacaggcagagggctcgtgcccccgccaacggcgaccggcgggggcacgagacgatcaggacgcgccggccagggccttggccatggcctgggcgaccttggatttgagctcgccgagatccacggacttgaccacgtagtagtcggcggcgatggatttgaggtcgtgctggaagctgtcgtaggcggtgcttaaaatcaccgggatggcctggtccttgccccggatttcctggaggagatcaaggcccgaacgattgccgccgagcttgatgtcgaggaccaccacatcgggagcatgcttttccagcagggccaggatgtcgtcctcgccgtccgaaaccgcgaccacatagccttcgccttccaactcttcctgataaagcatccgaatatgcttttcgtcgtcaacgacaagtattttcccgctcatgacaaactccttgcaacgcttggcaaaaccgacaggatgcctgtccgatgcttccatcttatgcgcaaaaccctttgcatggtcaaccgttttcctaccgtgaccggcttgattccgggaaagggccaggatactaagctgggccatgatcaccgtgacttttgacggcaaaaaccagccgaccacctacccgaaaatcaagaccgtcctccaattgctcaacaatcttcacctgcgcgtcaacgacgcgctcatcatccgcgacggcgaactgctcaccccggaccgccatctgtggcccggagaccatgtcaccgtgcggatggtggtttcccggggctgacggccggctttgacgccctgcccccttttcggcgcggcgggacatacggccgccgatccttttttgccatgacaaggaccaatccatgaagtgcaagcgctgcggcgaactggcggcggtcaagctgccgagccaccatgccggtttctgcccgagctgtttcgagggatttttcaaaaagcaggtggagacggccgtgcgtcgtcacggcatgatcggccgtgacgagaaggtgctggtggctgtctcgggcggcaaggactcgctggcgctcatgcgcgtgctcaccgacctcggccatgtggtggagggcctgcacgtccacctgggcatcccggactcgtcggacccggtggccgagcgcaccagggccttttgcgccgcaagcggcctgaccctgcacgtgctccataccgccgaacacggcctggccgtgccggacgtgaaagacgccgtgcgccggccggtgtgcgccgtgtgcggcaagatcaagcggcactacttcaaccgcttcgcctacgaaaacggcttcgccgccctggccaccggccacaatctcgacgacgagacggcccggcttttcgccaacgtcctgcgctgggacccggcctatttgggcacccagggcccgacgctgcccggcgagggcaagttcgtgcgcaagataaagcccctctaccggctgaccgaattcgagacggcggcgtattgctttttaaagggcatcgaccactggaaggcggcctgcccctacagcggcggagccagcttcaccggccacaaaaagctcatcgccgacctggaagaccgcagccccggccagaagatcgcgttttacgaggcgtttttggcccagggccggccgcacttcgccggcgcgtcccggggcgaggggcaggatacgctgtacgcttgcgcacagtgcggtttcccgtcgtccggggaggtctgcggcgtgtgccgggtgcgcgagcaggtggcggcccacaaggcgcggcgggaagcggtctagcgccgcccttcccctacttcttgggtgtggcggccttggtggccggcttggccttggctttgggggcgggcttaggctttttcttcttcggctttttcttgggcagcttgccttcttcggccaacttgaacagcttgcgctttttcgaatcaaaggtcagggcggtgttgatggcggccagggccagggcggcgatggtcaagatcaccaccaaccctttttgcaactgccacttctggttctccatcatatcggccacccagccctggccgtagcgctgaaagaaatagaccataagcggcacgacgataagcgacagccccaggctggccacttccatccacatgaaattgcgcccgaaaagcatgacgaaaaacgtggtgtcgcgcacgacccgcagcgtcaccagccgcgtgcgcaaggtctggatgcgctcgtccacctcgggcatggtctcgcggcttttgcggaaattctcggcctcgtccattttggccgtgcgcatccagttgagccttgtggcgcagtagttgaagtcacggttgaactcccgcagcatggccggaaacgggaaccaggccgcctcgcgctggatggcccgcaggtcctccacctgccggtcctggcgggcacgcatggcggccagctcggcctcaatggcttttttgacctcgccctcgaagacgtccaccccggccacaaaccgcttgaaggccacataattgctgaccttgccgagcttgcccagttcctcggctcggccggccgcctcggccaggtagggatcttcgtcaagaaaccggccgcgtaccgcctcggacaactccgtcaggaccaattgccgtcccttggcttcatcccgggccgcgttccagatgcgccacaaagccccaagcacctgcaaccggccccgctccagctcgggatcgagcatcacccgatggaaggtcggggcgtcggcggccaccaggggcaggagatactgcaagccctggtcaatgaagcccattttcaccaggcacacgccctggcggtaggtcggttcgatccacttggggttttcgcgcagggtttcacgatactgggcgatggcccggtggcagtcgccctgaatctcccaggcccggccttcgagaaaatggaaatagccgcgctgcagggccgtgtagcaaagccggcaggattcctgccaataatagacggtcttggtccagtcgccggcctccagggcctggaagccttgcagggacttgggctggtaggcccggggatacttggacagggcctcggccatgagcgcgtcgtagttctcgccgtcgccggcccgaagggccgacagcgccccccagatgaaatcgccctcgcgctggccgagttggctcaggccatcgggaaaggtcttgcccttgctgcgccacacgatctccagcaggcgcaactggaagggcatgtcggtctcgaagatggactggtaatacagcgaagccgcgtcgctcccgccgagcagccgggccgactcggcggcgaaatcggcggccagtgcgctttcgaggccctcggacaaggcttcgaggctgcccatgtccacatcgccaaaccgctcccacacgccgggatccagggccatgagctgcttggacgggcagttgcgcggctcgtggttattgagtccgcagtagaagcacggcttggcgtcgccgccggacaaggccgaaggcagcggcacggccagctcgccctgggtcgcctcgtcggccgcggcctcgtcggccgcctcgacccgggccaggctcacgttgcaccagtcctcgatattgatgccccgggacagcgtgcgggcctcgtggatgacgaaatcgccgcccaataaaaaggccgtgcggtagctcatgtggggaaaatccgggctcatctggtcccagtccaggcccaggcggcgcggcaggtccttgcccagggtgcggcccttggacgaggcggcgaccatgacgcttggccaatagtggccggactcgccctcctccttgaggcgcatgatgcgggcgatggtgtcgcgcgcccaggtgcgcagctttttaagccccgaaagttcgaaaaggagaaagccttcatggcgggtaaacttgacgcccaggcgttcgacgatgtcgaggagttcctcggcgatgttgcgccagccctcagcggtgttgcggcttaaggggtcgcccagggggcgcagcacgcagtaccagatgagccccggatcgtaggccagggcggtatcggcgtccaggcgctcgaaagccacccgggccagccccatggtcggcttgacgggctggagcgacagccccgggatcatggccacctgggacttcaaattgggatggagcaggacttccagggtttcgcccggcgagacgtgctggcgcgagagttccacggacatggtcagcgaccggtcgaacttggggccgaccagcatggccgccggcaccacttcgatgaaaagccgcatgggattgaccttgccccacacgagaatgcgccccagggcccgcaatccctcatcgccgcaaaaaaaccacagggcttggccgtaggcgtcggccatgcgcaggccgccgtattcttcgagcatggtgggcacgcccgggtcgagctcgccgtcccaggtcatccagacgcagatggcgttgtgcaccatgcgcgtggtcgggatttgcggcagcttctccagcagattggcgatgtaaaacgtggacaacggggctgttctcccttacttgccgcttatggacatctcaaaaaccatcgcctcgctcaaaaccgagccgggcttcctggaaaaggtcggcatggtgctcgtgcacaacggcgtggcccgggccacgtcgcgaaacggcgctcccgtgggcaagctcgaagtcacggtgaaccaggaactcgtcgaggccatccgccgcgaaggcgaagccatgcccggcatgttccgggtgctggtcacggccaacgccggcgtcttcgtgcccggcgacgacctgctttttatcatcgccgccggcgacatccgcgaaaacgtcctggccgcgctgacccacacgctgacccgcatcaaggccgaggccatcagcaagcgggaaatcgcgcccgaataacgcggcgcggacggcgaccggggggcaatgccggccttggccggccaacctgccctgccaggcaaacccgggacggcttggagccgccgggttggggtggtgttgtcgcggcttgccgggtgcgttcatgcctgtctcgtttgtcgccgtagggcctatccggccgcgccggctgactcagccggccgccgtggccggcctgtcggccgttgtcttgccgcctgccccggccagtccggtccgggcggtgtccagggccgcttccaccatggccgagacccgggcggcctcctcgggccggtcgcgcttgaggcagccggcggcgtaaatggcggttttacgtcgcaactccttctcaatgcaagcaaagtgccaggcagttgtttccggccgccccagcaagcccaccatggcccggatgcgaaagaggtcctggccgatgtagagggtggagagctggtcgccccggccgccgtggcgcacgacctgatattcgtccaaaagcccgatggggcgcgtgagcatgatgcgcagccacaggtcgtagtcctcacaggccggcaggctctcgtcgaaaaagcccgccccctcgatgacgccgcgcctgaaaatggtggtggacggactgaccaggcacatgccgagcgacgcctcgaaaaaccagccgtcaggctttttgtggatatgggtggggttgacccgcttgccgccgcgcatccagatttcctgggtctggctgacggcgtggccggtggcggccatgtaggcgagctggcgttcggtcttcttgggcagccattcgtcgtcggaatccagcagggccagatagtcgccgcgcgccgcccgcacagcttcgttgcgggccgccgacacgccgccgggcgtgtggcggcgcagcacccggattcgcggatcgtcaaagccggccaacaccccggccgtgtcgtccaccgagccatcgtccacgatgaggatttccagggcggtccaggtttgccccagggccgaggccacggcccggggcagcaactcggcccggtcgcgggtgggaatgatgaccgtgacaagggggccggccgacgataggaaaccatcatgcgtcatggccccgacactacatgccgggggccgcgctgccaaggccgccggccttgggacgctttccccaaccggagccgccatgatggaccagccgcatctcgaccccgtgcgcgactaccgccgccggaccgcccgccgtccgggcgagcacagcttccaggtggtggtggcccagaccgatctttacgtcacggcccagcacgatctggctcgggacatggccgactacgtgtccgagcttcgggccggcctgtccacgtatctgctcctgcatcccgacttccagcgcagcctgacgccggtggcggccggcccggacgcgccggccatcgcccaggacatggccgaggcggcgacccggtttggcgtggggcccatggccgccgtggccggggctttcgcccaggccgtggccgaccggttcgtgggccgctccccggagctcttggtggaaaacggcggcgacgtttatctgcacggcaaaaaggaacggctggtggccctgctggccaagcccgtggaaggggcacggctggccttgcgcttcgacgcggccagcctgccggcggcggtgtgcgcctcctcggccacggtggggccgtcgctgagcttagggcgagccgacatggtgacggtggtggccgaccggggggcggtggccgacgcggcggccaccgccctggccaacctgctcgtcacggccgaggacatggaaggcgtgctggccgccgccaagggcatggcccggcgcggcgtgcgcggcgtctttgtccagctcggcgacctcgtgggcctgattggcgagctcgacctcgtggccctggaataagcgccgtcagcggccttttcccggaccaaaatagacagtctcttcacgggcgtcgactcgtgcccctctcccgcccgacgccctgcccagacaacaaaacgggccgcctccccaacaagggaagcggcccgttggctatttttctcgcgccgggcggcctagacgaagaccagcgccccgtcctgcatgtccaccgtgacggtctggccgtccgacacctggccgccgatgagggccttggccaggggcgtttcgatgtgggcctgcaaatagcgcctaagcggccgcgccccgaagaccggatcgtaggccgtctcggcgataaacgccttggccgcgtcggacagcgccaggctgatcttgcggtcggccagacgggcgcgcagcccgccgagcatgagttccacgatggcggcgatctgttcgcgcaacagcggcttgaagagcacgacctcgtccacgcgattgaggaactccggccggaagtgcccgcgcaaggtgttcatgaccgactcggacacgccttccttgaactcgcccgagggcaggatgccgtcgagcatgtactgggccccgaggttggaggtcatgatgatgatcgtgttcttgaaatccacggtgcggccatggctgtcggtgagccggccgtcatcgaggatttgcagcaacgcgttgaacacatcgctgtgggccttttcgatctcgtcaaagagcaccacgctgtagggcttgcggcgcacggcctcggtgagctggccgccctcgtcgtagccgatgtaccccggaggcgcgccgatgagccgggccacggtgtggcgctccatgtattccgacatgtccaggcgcacgatgttgtcctcggtgtcgaaaagcgccgcggccagggtcttgcacagctcggtcttgcccacgcccgtggggccaaggaagatgaatgacccgatgggccggccggggtccttcagccccgcccgggcgcgcagcacggcgtcggccacggccgtgaccgcctcgtcctggcccaccacccggtcatggagcacctctcccaggcgcagaagtttctcgcgctcgctttccagcagccgcgtcaccgggatgccggtccaacgcgagatgaccatggcgatgtcgtccggggcgacttcctcgcggataagccgcgtgccgccggccgccttggcgatggccgcttcctggccggccagatcgcgctccagaccggccaggcgaccgtagcgcagctcggccgccttgttgaggtcgtaggcgcgctcggcctcctcgatagccagcttggtcttttcgatgtcttccttgacgcgccgcaggacctccacggcccccttctccttttcccactgggtcatgaagctggcctggctttccttcaaattggccagctcttcctcaagcttttccaggcgctcgcgggaggccttgtcggtttcgcgccgaagcgcctcgcgctcgatttccagctgcatgaccttgcggttgatctggtcgagctcggccggcagcgaatcgatctcggtgcggatcatggctgcggcctcgtcgatgaggtcgatggccttgtccggcaactgccggtcgggcaggtagcgctgggacagcaccgccgcctcgaccagggatgagtcattgatgcgcacgccgtggtgcacctcgaagcgctcgcgaaggccacgcaggatagagatggtgtcctccaccgtcggctcgtcgacaaagaccggctggaagcgccgctccagggccgggtccttttcgatgtacttgcgatactcgtccagggtcgtggcgccgatgcagtgcagttcgccccgggccagcatgggcttgagcaggttgcccgcgtccatggagccttcggtcttgcccgcgccgacgatggtatgcagttcgtcgataaacaggatgacccggccttcggagctctgcacttccttgagcacggccttgaggcgttcctcaaattcgccccggtacttggccccggcaataagcgcgcccatgtcgagggcgaagatggtcttttccttgaggccctcgggcacgtccttgttgacgatgcgcatggccaagccttcgacgatggccgtcttgcccacgcccgcctcgccgatgaccacgggattgttcttggtgcggcgcgacaggatgcggatgacgcggcgaatctcctcgtcgcggccgatgaccggatcgatcttgccctttctggcggcgtccaccagatcgcggccgtacttggtcagggcctcgtaggtggcttcggggtcggccgaggtgacgcgctggccgccgcgtatctcggtcagagcggccaggatgcggttcttatcgataccaagcgccttgttcacctggccggccagggtggacggcccctcgtcgcaaaaagcgaggaacaggtgttccacgctgacgtattcatccttgaggtggcgggccagatcctggcccttgaccagaatttcgttgaggcgcggggtcacgtagacctgccccggctgcgcgcccgggccgctgaccttgggcaggcgggacagcccgcgttccagctcggccagataggcctggctgttgtagccggccttgtccaggatgcggggcaccagcccctggtcctgggtcaacagggcatagagcaggtgctcggcgtcgacctgctgttggcccatgcgaacggcgacggcctgggcctcgccgatggcttgctgcgacttttgcgtaaacttgttgagatccatgcgtatcctcctccgtggctgtccaacagataagatcgcttcggagcttggcaacaactctgcaaaaatttattttccccgccgcaaccatagtcttgcagcgtaaaaaaacaggctacagcagtcgatgcagctcgttgaccttgccttccagatactcgatgcgttccagcagatcgaccacgatgctggctccgaggagcggcagttcgaaatcgcgctggatgcggtcgagcttgcgcaggcgatagacgtcgcggctgcggaacaaataggcctcggccgtggtgcgctcgggggtgatccagcccagttcgatgagttcgccgacaacggtcgggtgcagaccggtgagttcctgaagctgggcaaagctcagcttttcggaccgggcggggacgctgccggcgatgacgacgtgcttgatttccatggcggcctccctcgctccctaaaagttcctggggctgaaatccgatgacacggcggcgagcttttcccagagttccttttgctcgtcgcttgcgcttgtcggcacctgcaccatgagccgcacgagctggtcgccgcgctgtcccttgccggaaaggcccttgccgggcaggcgcagcttgcgcccggaggacgagccggccgggatgttcatctccaccgcgccgtccagggtcggcacccgcaccttgccccccagcgccgcttcccagggggccaggggcaggtcgaggatgacgttggcctcctccagcttgaacagcgcatggggcaggatcttgaccttcagatacaggtcgccggcctggccgccggcccggccgggattgccctggccggccagacggatcttggccccgtcgcgcaccccggccgggatggagacgttgagccgcttggtgcccaggcgcggggaaccgtccgggccgatggtctgttcctgaaaggccacttccttgccgccgcccttgtaggcttcctccagggtcagctccagggtggcgttggcgtcggcccctcgggtggggccgcgcgaatagccgccggccccgccaaagccgcccgcgccgccaaagccgccgaaatcggtgaaccctccggcccggccgccccggccggcggacgcgccgccgcccatgccgccgcccattccaccaaagatggtttcgaaaaagtcggagaacgacccggcgtcgaactgctggccgcccgggccgccgaaattgtagcggacgttttcaaaccccggcggacgctggaaatgctggccgtcctgccagttggctccgagggaatcgtagagcttgcgcttttcggggtcttttaagacctcgtaggcctcgttgcactccttgaacttcttctcggcctcggggtcgttctggttgaggtcgggatggtgcttacgggcgagcttcttgaaagccttggatatttcatcctggctggcggtcttggagacgccgaggagcttgtagtaatccttgtatgcaacgctcataggggcagtatctcccatttccggctggtggcccggcaagtttacataataagtcgaggtcctgccgcgtcaaccgccggaccattttttcggcgaactccctgccctgtcagacctacaccagggcagcggcaaaggccagaggcgcgcttgccaaggccgccccaagccgctagcctgcccctcctatgtcgaaaaaagacgaccccaccgcctttcgcccctttgccgactccctcaaaggcgtcaaggtggcccggaaaaaggaccttcccccggccgtgtccaaggccgtggccgctgccgccgccaaaccgaccgctcccgaggaaattgacgaatcggatttcctgcgggccatgtccggcgtggccaagctcgaccgggaaaaaattggcggccgtgacgtgcgtcccgtcgcgccgccgccagcccccccctccccggccgacgaggagcaaaacgcgctcaccgccctgcgcgatctcgtcgacggcaaggtggaattcaccctggaatacagcgatgaatacgtccagggcttcatcaccgacctcgaccccaagatctaccgccaactgcgggccggccagttctcgcccgaggcccatctggacctccacggtttcaacgccgatcaggccaagctcaccctgttccatttcatgcgcgagcagtatctggccggcaagcgctgcctgctgctcattcccggccgcggggccaattccccgggggggctgccggtgctcaaggaagaactcaagtcctggctcacccacgaccccttaaagcgcgtggtgttggcctttaccaccgccctgccccgccacggcggcgcgggcgcgctgtacgtgctcatgcgcaaatacaaaaagaccaagggcaaggtccgcttcgaaaaggactggccggatttcggctagtgtcgcgtccggcaaccgtcgccatccctgccccggatcacgaaaaaacgcggccgcgccctttcggagcgcggccgcgtctcgttttgcgtcaaattttcgcttcaggccgcccaggaccccgacggggccagacaggcgtcgatctcccgggtcttttccagaatgcggccccggatggccttgaatgccgtcagttccttgacgccatagcgttttttggtctgcaccagcccagccaagtccatgatctcgttgtagagatagggcatgtagagcggatcgtggcgggtaaagaactggatctgggagagcaggtccttgatctcctgctggtgcttgtcggccttgcgcatgagcttttccagccgccgggaagcgtttttgagcgacgtcgcccaggacgcggccttgggcgcgaagatgggccgcacgcgcggactggccgcccgggccagggccgagagaaacacgtccttggccgcgccccggctggcgaaaagctcccccgaggccagatcggccggccccaagttgaccgcaccgtcgatgaccacgccgccgccgtagaggttgaaaaacccggccgaggaggcggcgatgtccttttcgatgtcgcgcttggcagccaaaaaacccatgtgggtgtagatggtctggccgtgcagattattgagcttcacgtcgtcgcggggattgtaggtgtgcacccagacggcgttgtggtggccgtccacgtgggtgcgttcgccctgccaggacaggtcgcagccgacgaacacgaagcgttcggccccggcccagcccagcaggcgttccaacgtcaccgacacgttgccgccggcgtccagcaccagttcctggtccttgagcacgtaggtgccgatgccgccctgggtccacagcgggatgcgcggcccgggataacgggccaccaccgccgggtccatcttggtggaatagacaaaggggatatcggccgcaaacgacaggtcgcgcaaattatccaggctttgcatcatgttgtcgttaaaatcgatggccagacacaggtcaggcttgatgcccagccgctccagggccggcagggtctggagggcggcggcgtaaaagcccttgtcgcgatgctcccgcagcaccggcgcgaacccggccagagacggacccgccccaagcagcacggccgtcagtcccttggccataccggccatgcgggccagactgccttcgtccatggcccgggaataattgcgcagttcgttgccgaccatgacttcctgcttgtggcgcagcgtggtgagctccaccgacaggctttccatcttggctttgaccagcgcccccaggcgcggatattccggccctatctgctggcaggccagatcgtttcgcagccagacccgggaaaacaggaagctcacgtcaaaattttggatggccagctcaatgtcggccgcgcggggcggcacgaaacgcagcttgccatggcgcagataaggccggtaatcggtctggcccaggcaagccaggagcatctccggccggggttcggccaccagcaccttgtgggaatccggcgtgccggtcagcacgtggttgaggccataaccgatgcccacgccgacaatgatggttcccgcgccctcaagctgctccttgggccgccagtcgcggtagaaaaacggcggtggcagcttctcgaacagccccacgccgtcgtccatgcgccaatccacgatgcccgaggcgttgcggtgcagccgctcgtggacaatggccggatcgggattttcctcggccagccagcgcccgaccgggtcgccggtctcggccagatacgccaggttgtcggcaaggtacttgttgatctccatggccccttccttggttgaactgaccaagcccaagcaaatttcctgccactcttgccggttggcggttttttgcctaccacggaccctgcccggacgaatgcgggccaaatttccgagaggcgcgccatgatccacgattccgtgttgtccctggtcggcaagacaccgctggtgcggatgcgccgggtttgccccaatccgcgcgtgaccatctgcgccaagatcgagtcgcgaaaccccggcggctccatcaaggaccgggtggccctggccatgatcgaagcggccgaacgctcgggggaactcacctccgggcgcacggtcatcgaggccacctcgggcaacaccggcatcggcctggccatggtctgcgccgtcaagggctacccgctaaagctgctcatgccggcctcggcctcggaggaacgcaagcgcatcatgcgtgcctacggcgcggaaatcgtgctcaccccgggcaaccggggcaccgatggggccatcgaggaagcctaccgcctggcccgggaagaacccgaccgctacgtgctcatggaccagttcaacaacccggccagcatcgaagcccactacgcggccacggccgtggagatcttcgaatccacgggcggggccgtcacccacgtggtggccgccctgggcacctcgggcacggccatggggctggtcaagaaattgaaagaactcaaccccgccatcaccgtggcggcggtggagcccaggcccggccataagatccagggccttaaaaacatgcaggagtcctatcctccgggcatatttaacaagcacgccctggacgccatcgtgccggtagaggacgaggacgcctttgccatggctcggcgtctggcccgggacgaaggcatcctggccggcatgagcggcggcgcggccatggcggcggcggcgcggctggccggggaactggccgaggggctcatcgtggtcatcctggccgacagcggcgagcgctacctgtccaccaccctttttgccgcgcccgagaaaaaaggcgtggcgctcaccagcgtcggccagcccgatccggtccatctcgacccggccgcggccgcgcccgggcttttcaccttcggcccgcccctgcccgaacccggcgacctggacgcctggcggcgcatcgtcaccctggacgtgctgcggcgcaccctttcccgctccggcggccggccgaccctggccgtgggcctggccgacctggacgaccgctgcctggatgcctcgcgggcggccggacgcaagtgccgggagtatgctgccgaagcccgggagcaggtcgccgccctggccgaaagcctgggcgtcgccgacgcggtctttcccctagccggcgaggccatggacgaggccatggccctggcccgaaagcttatggacaagggcctggcctacgagaagctgcgcagcgtctacttcgacgtggcccgggacaaggcctacggcggcctgctcggcctggacatgaccaagctgtgcctgggcaagaccgtggatctcgactcctacgccaaggaccatccccgggatttcacgcttttaaagcgcgtgagcctcaaggatctcaaggccggcgacgtctgggccacggcctggggcaacgtgcggccgagctggtttctccagatggcctcggcggccgtgcgcgccctgccggccgtgacggtggtggccaccgacgaggacaagaccttcccacatatcgagaacctgcgcgccgtctgggctggcggggccgggctggccccggccgtctggctggtcggcgggcgcatctgcggccgcgaaggggccgaggccgtgccgaccctggccgatctgcttggctacggcgtccatcccctgaccgtgcgggcctggctgctctccacgagctaccacaagcccctttgcgccgcgcccgaggccctggccatgtgggaacgcaaccgggcgcgcatccaggaactggccgccggcctgaccctggccgccggagagggacaaccctcgggcgcggcccaggccgaggccgaaggattggaagcggccctggaggccgccctggccgaagacctgtccgtggcccagttctggccggctcttttcgccttcgcccgccaggccaacgccggactggccgcaggaacgcttggcggcgccgacgccgcccgccatctggccgccctggccgccgccgacgccgcccttgggctgctcgacccggccgggctgccgctgtcgcccccccactggccggccgaggcggcgcggctcatcgaagcccgagcccaggcccgggcggccaaggacttcacccgggccgacgccctgcgccgcgacatcgaggccatggggctgcgcctggaagacgctcccgggggggcgcgccttttcgctgcccggccgtctccgggccggggcaagccgtgagcgactgtctggccacgggattcgccggctgcgaccgggcggccgatccagacattttcgtgcgctgcctgcgctatctcgccgccgccccggggatgcgatccatcaaggacgaaagcctggcctggctgggccttgcccccggcgacaccgccctggacctgggctgcggcctgggcggggaagcgacggccatggccgggagcgtcgccccgtccggtttggccgtgggcctggacgccagccgggtgatgctggcccgggcggccaatgcagccggtcaagccgccgtgcgtccggtcttcgtggccggcgacggcgctcacctgccctttgtcgacggagccttcgccggctgccgggtggagcgcaccctgcaacatgtgcccgtccctggggctgtgctggccgagatggcgcgggtgacgcgcccgggcggggcagtcgttgccgtggagccggactggggcacgttcgtggtggattccagccatacggctgtggcccggcggttggcggaattttggtgcgacagcttccgccgcggctggatcggccgagaactcggccgcttgctgtccgaggccggcctgaaggaaatcgaggtgatcgggcggtcgcttgtgctgcgcgaactggccgccgccgaggcggtctacagcctgtccgacacggccgaccgagccgtggccgccggggcgctgccccagggcgcgacggggtcgtttctgacggaactgcgccgccgcgacgcggccggcacgtttttttcgagcctcaccttcttcctggcccggggccgcaagccccggacctgacgccggcccggccgcccggctatttgggcaagggcgcggccaccagcaaaatccatttctcgccaaaggtcttttccgcaaaagccttgcgaaaagcggccatgccggccggctcggacagcatcagctcatggctgccccggcccggagtggcgtgggcgaagcggaccttgccggcggcgtcgcggtaaaggacgccgacgtggtagtaatagaggcggcctttgatctctttgctcagcgccgcgtaagcgacctcgcccggagccaacttcggcagcacggcggcccaggcggccgcgtcgtgcaggggaaagccgcgaaaccgggccgcgtccacagcctcgggagccggcggcaggcccgggcccggcacaagcagccgacggggcaggccgtcggtgacgtttaagatcaggtcgtagccgaagtcccagtcttcgccggccgccgcgcccgggccggaatcgctcttgcggtcgcggcgcatggcgtccaggggcagggggcggcccaggatgccccgggaggccgtgaccacgaagccgctgcaattgagcccccgatccgggaaggttctggactggtcggcaaacagggtatgacggccggcggggtcgtccacgccgtcgtcgcggtagggcgtgccgagaagcggggtcacggcgtcggacggcgcggcggccaaggcggcgtcaaagatgcaacagacggccaaagcgacggccagggcgaccaggagcgtttgaccgcgcggcaaaagccgcgtaacatccataagataatcgggccgcaaggactggggccgtttcccggacaaggccggaacaccacggaagttgctcaggaggcggagcatgaagtttaccattgagatcaagggtttcggtcagcgcattttctattcctacattgagaaggaagtggtgcgcgaggcccgcgaagccaaccgggaacgctacatcgaatacatctaccacggcgtggacaacaatctccactcttcgggcgaggatctgctggaaagcaaccgccccgtggtctacattattgtcaatgaaaaagaaaagctccgggtgagcctaagcaagatcaattgcgaggtcaagagctacccggccaagaagattttccagccctacgtcaaaaacaatctgctgtactgcttcggctacaatgaagaatacatccacacgtattccttcagcgacgtcgaagagatcgatatcgacaagatcaccgcccgcattgtggagacagagatccccaagactatcgaaaacaacgtctggctgcaaaaagtcatccacatcgaaagcatgctctacgacggcaaggagatcaagcgcgaggagttcctgtcgcgccccatggggaccaacctcgggccggtcattatcgatctggagtaagcgccgcctgttggcgatgcgaaaaaagcccggcgcatgcgccgggcttttttgttgccccatgcggggggtctgggggcctcaggcccccagccgccggaggcattcttcaatctcccctcgccccccgttatcgcccctgttcagcaattacccgcagctctcgggcggcggcttcggggtccggggcggcgcagatggctgacaccatggccagtccggccgcgccggcggccatgaccgcggccgcgttggccgccgtcaccgcgccaatggccaccaccggcacctcggccagggcaatcatgcggatcaagccctcaatcccctggggcgcgccggcgtcttttttggtggccgtggcgaaaaccggcccggccccgaggtaatcgaccggctctccacgggcggcccgggcctcgtcctcgccggtgacggaaagccccagcaggcggtccgggccgatgagcgcgcgcacgtcggccgggcgcatgtcgtcttggcccacgtggacgccgtcggcgtcgcaggccagggccacgtccacccggtcgttgatgacgagcctggctccaagggggcgcacaaggcctaccagcgcccgggccagctccacgaactcccgggtgcaggcgtttttctcgcgcagctgcacgagcttcgccccgccggccacggcccggcccacgacgtcgagcaggtcgcgaccggcaaggcatccccggtccgtgacgagatagagggttggatcgaagttcggtttcatgcgctcacccgcgccccggccgcgatttcggcctcggtgaggctgtagaccacatccaggaaacgcacggccaggctgcccggaccggccacgccggctgcggcgaggcggccggcggcggccatgacggccatggcgtggcaggtagcggcgaaatagtcgggattgacggccaaaaacgcgcccacaaaggccgtggccgtgcagccaaggcccgtgacccgggtcatcatggcatggcccccggccagctccaccacgcgctcgccgtcggtcaccacatccacctcgccgctgacgcacaccgtgcagcccagggaccgggccagggccacggcggccggcgcggcctcgcggctggcgtgctggctgtcggcgcccttggaaagggcggcctcgccggccagggcgaggatttccgaggcattgccccggacggcggccagccgcacggtttccagcatccgcccggccacctcgcgtcgccgggaggtgacgccggcggccacgggatcaaagaccacgggcacgccgccggcattggcggccccgcccgcagccagcatggcctcaatattctcgccgcccggggtgcccatgttgcacaccagcgccccggccagggcggccagttcggcggcgtcggccggatggtgggtcatggccggcgaagctcccagggccagcagggcgttggccgtggcattggtgaccacgttgttggtgatattgacgaccagcggcgcgttttgacggatgcgggcgagatcggcgaagacggctgcggcgaacggcatggcgatgtcccgaggggttggagttggcaacaatcgactggcttggggatagcccgaggcggcccccttggcaacgacggccgggggagttgacggcaattgttgatcagctatatcggattatggtccgacgtgaagtacgcatccccgccctggccgtcctggcttggacgctcctgcttggactgctgttcaccatccaatacctgtcggataggcaaagcgccgaagccatgatgctgcaggcggcccggggcattttccagcagatcgtgctcacccgggaatggaacgcccagcacggcggcgtctacgtgccggtgaccccgaacagccagcccaatccctatctccccgacgagcggcgcaccgtgaccaccctcgacggcctgacgctgacccgggtcaacccggccttcatgacccgccagattgccgaagcagcggcccaacgcgacggccttggcctgcatctcaccagcctcaatcccctgcgcccggaaaacagccccaccagctgggaagcccgagccttggccgattttgaaagcggcgacaccgaggcccacaacatcggggcaaccccggccggcccggtctttcgctacatggccccgcttttcgtgaccgagagctgcctgccctgccacgccaagcaaggctacgccgtcggcgaggtgcgcggcggcatcagcgtcacattgccggccgggcatttcctggccgcccagtccgccgccgtcggcggcacggccgggctttacaccctcatctggctggtgggcgcgacctgcaccggcgtcggcacggccaccatcctggccggcaaggccaaggccgaagcagccaaccaggccaagaccaccttcctgtccatcctcagccacgaactgcgcacgcccttaaacggcgtcctgggcatgttggagatcctgggttccacccgtctgaacgaggaacagcgttccctgacgggcgacgcccgggccgccgccttggccatgaacgcccaagtccaggagctgctggaactggccggcctggaaaacggccaaggcatgttgcacatgacccgcttcgccccggtcaagacggtggaggaggccgtggcccccctggcccaggcggcccgcgacaaggggttggctttcgagctgctcacggcggccgatttgccccgggaactgcttggcgacggcgaacgccttggccgcatcgtgaccatcctgaccgacaatgccgtcaaattcacggccacgggcgggatcaaggtagcggtctcggcggcagccgccgccgacggttcctgccggctgagcgtggccgtggccgacaccggccacggcatcgaggacgatcgcctggatgccgtattcgagccgttttatcaggccgaaaacgtgctcacccggtgcaagcccggtctcggggccggcctgaccatcgcccgcaaacacgccgaactcctcggggccagcctcgcctgccgcagcacccccggcctgggctccacgtttaccatcaccgcgccgtttcggctggtgtagggggaaagcggggagaaaggcatgcctccggcggccgggggggggggacccaatgtctggcctgggctattacgtgaccagctttagcggcccaagccgctggttttcctgctcctgccgacgaaggtatctcggatcagcttttgtcacgaccaacggtcgattcaggctccttcaccggaacggtcggcgccgccggcgaaggccgcaggccactgccttcgccgggcggcacacaggctactttttggcgctggcgccggcgttgtactggtagttgccctcaaactggtcgagaacgacggtattgggtgggttggagtcggcggcggccgtcagattcaactccttgtccaacttgcgtgatctgaactgccatcccttaggcaaggtcaggcgcttgcccagggtgggcaggttttcgatggtgttttttggatcgatcttcagcgacagactgaacatggtgtatacggcgccctcgggcgtgatcagttcatacaccgtttcacccgcatggaaaacaaagctgctggtacgtttggagaccatcggctcgtaggtcggcatctttccggaagcgaacttttccaaattcggaacttcaaaaatgccgtccagtttcaagggaatcccggcgatcactctctgcttgcagccatcccaggacatcccgcttacggtgttcgccaccaaacggcgcgggccattgaaaaagacaccgttgctcccgtactccttcatcaaggtctccgcacgcagagcgcggaagcgggcgtccatctcctcgttgggcgcgggaaggtcgttgctgagagagttaaagtagttgccgatcccgccgccgtcgggctggcggaacatgaacagaatctcgtagaaagccctgccgcgccagttctcagccttgatcgggcagggatcggtcagcttgaccaccggttgggcttccagtttggcttgtgcttgtgccgtggagtggcaggccaccgcagcgaccagcgtggcagcggtgaagagggtcgtcaatacgatctgcatacgcttcatgatggctcctctcgttagtgtggataagcggagagcgaaactaccaatggggacgcgcgccgaacctgaacacttctggcaggttcctggtttggaattgctcttgccgggaccggtcttgtcgtagacgctcaagaactcgtcgacgaggatcgtcacaacgtctccttatacgcaactgcggtccgcttcatgttgatgatttcgacgagcgcttgtggagcactttccctgttcacgggcatgtccgggtttacatacgagccgtagcaattcgcaacgataacgcctgtcttcggatcgatggcgacgaggtacctttgcaatatttcataaaatcgccatttctggccggggaggtcaaggggaaagtttggggaaagtgctactcgtgcttaaactaaatccaactcgtttcaaaccagatagagtcgacacaggcagctgtaccgataatcaggctacaaccaaccgccaactgattaatacttcaacattattctgacgaataacttgcctgaatcgccaccgccccccgcaggggaaaaaggcggcggcccgacaaaaaaagacgggcgtcgaacttgcgtccgacgcccgcccggccaatggcggcctccccctagctggcgagtggtaaccgtgtgtgagactgcctgccggctccacggggcgtaaccgggtatcccggtcgccggagtttgcggcaggactgcccgtgatgggggcctggctgggaaatcttgatgctcctcatccccgcatctgctcgatggtgcgctccagctcgcgcccaagcggggttttgagcgacagatgccgctccagggcggtgatgcccttgaccaccgtggaatggcggcgattgaactgcacgccgatgtcggccagcgacaggtcggtgtgctgccgggccagcaggaaggccgtgttgcgggccaggacgtactggcgcttgcgcgacttggacttgagctggtcgggcgaaaggcggtagacgtcgcagacgtagcccacgatgtcgtccaggctgaccggggcctgggccacgtcgtagtggcgcagcacatcccaggccaggtccacggaaatgcggcaattgaggagcttggccttgagcacgaggttctgcaggcagctctccagttggcgcacatccgagggcagcttgtcggccagaagcgtggacacttcctcgggcaacagcacctgatgcacggcggccttgcgggccaggatgcggcggcgcatgtccaggtcgggcttgtcgatgacggccaaaaagcccgagttgatgcgcgacaggagctggctgtccaagcccgaaagctccttgggcaaaaaggagctcgtaaagaccagacggcagccccgggcgttgagggcttttagggtattgagcagctcgtcctggatgcgcggcttgtcgcggaagaaatgaacatcctccagcaaaaggacgtcgacgttttcccggaaggcggccttgaactgctccacctgcttggtcttgatggccatgaccagccggttggcgaactcctcggccgacagataggcgacccggggctgacgtccgggctggccgccgaggatgcgacggcccatggcctggatgaggtgggtcttgcccaggcccggagccgagctgatgaacagctgctccgccgacaaggacagatcgcagatgcccttgcttgcggcgtaagccatctcattggacgggccgaccacgaactcgtcgtagctgaagcggaaccggtcggccaaagccggcggggcgctgggggccacgggcagggtcaggggtgcggccacgggccgagggccggccgggcgttgtcctggctggcgacgggggcggccggaggcggccggggccagcccagccgaggcggcgaccggggcggcggccctggaggcttcgaccacaaacacctggggacgcgcgcccatggccacggcggcggcctcggcaatggaatcggtcagtcgttcgcgcacccaggtggccacaaaggcgttgggagcgacaagttccagcgcaccatcacgggcccgggccgcgaggggcttgatccagaggttgaacagtccggggctcagggtcttttcgagcagttgtttggtttgtgaccaaatcgtttccatggcgcgcacactacggccgctccgtggccgggcaaaggacgattaggctccggattccggggggcgtctctttggttctctacagcgcaaccacctggaaactggttcatttctcgccaacccccgtgaaacgtgggctttcgtggcaggccctcaagccgcatggcgcaagggtttcccggcagcgggccatattatgcacacctgtgaaagcgttttccacaggtattctcgtcattatctcaatccatgtcacttgaagtcaaaatatttcgtcttccaacaggccactttttggttgaccaccgccaaaacccgctcggcccttacctttgccggccgtcaacaggtttcggcaacatgcacacgacacgaacaaccacacaatttcattcataaaaaaactttatcccgcatttcccggctcttcggacgccacaacgaaaaagcccgccactggcgtggcgggcttgaaaatcagacaaagaaagccggatttcgggaattaggcggaatggggaccgatttgcccgagtctgggatagcggccgcaggtgaagcgctcggcctcgggacagtagccaagccgctcgcagcgcgccccggccccggcaaagatcacgggcagggcctgccgacactggtccagcatggccagggccatggcccggatctcccactgggcccgggtgcagcaacgcagctcgaagaaatgcaacagcgagcggcagttcatggtcacgaccaccttggtctcgcaggcgttgggcaacatgaaccgggcgtcctcgttggccttgtccccgcgcccgtggcgggccaggatctcctgcagctcggcatacgccgtcccggcctgctccatggccgattcgtaccgcgccctggcctcgggaatggccgcgatctggggcggcagcacgtaatcaaagcccagggcgtccacgtaacgctgggactgctgggaatagctggcgatgcggtggcgcacgagctgatgggacagcgcccgggacacgccggaaatcgcaaaggtgaacgacacgtgctcgatgggcgattcgtggccggactccagtatccgtgccacaaaagcggcctgcttgtccggggcgatgtcgccggacagcaggcgcggccacagatcggccacgtcgccggcatggtagcactgccgaaaagcggcataaatgagggccaacgcgtcgggggtatgggccagtaacgtcacggcaagccgagtcggcggcatgttgcgtccttggtagagattcgtcgtgctagagattcgtcagaaaaaaagcctccggcggccaaagggctgccgccctttggaatcccgcatcggggctggccttggcgggatagtggtcccatcaatgtcgtcgcgtgaaagaccattgcctgcttcgcttcctgcgttggccgacggcccggcgctcgtgtcgcgtccacgaaaaccacacagagcttttcgaagacaacagtctaaaccattaatattttaaaaatactatggtattttttatgagacgcgacactagcccaatttccccttgatatgggcataggccttggccgtggccacccggccgcgcggggtgcgctttataagcccgcactggatgagatacggctcgtagatctcctccagggtgcgcacctcttcgcttagggccacagccagggttttgacccccaccggcccgccttcataatggtggatgagggtctccaagatcttgcggtccatcatgtccaggccgtggggatcgacgtccaggcgagccagggccttggcggccagttcgccgtccagggtttgcgctccggccaccaccgcgaaatcgcgcacccggcgcagcagccggccggcgatgcgcggcgtgccccgcgagcgctggccgatggccagggctccgtccggggtgatggcgatgcctaaaatcccggccgcccgggtgacgatgcgggccagctcgtcggggccgtagaattccaggcgaaaaatgacgccgaagcggtcgcgcagcggcgaggtgagaagcccaagccgggtggtggccccgaccagggtgaagggttcgaggtcgatgcgcacggtgcgcgcccccggcccctggccgatgatgaggtcgagcttgaaatcctccatggccgggtagaggatttcctccaccgccgccggcatccggtggatttcatcaataaacaggatgtcgccccggcgcaggttggtgacgatggcggccaggtcgccgcagcgctccagcaccggcccggtggtctggaccagattgacgcccagttccgaggccatgatctgggccagcgtggttttgcccaggcccggcgggccgtagagcaggctgtggtccagggtgcggccctgctccagggcggcgcgcaaaaagaccttgaggttggcgcgcaggtcatcctggccgatgaaatcggccagccgcgacggccggatggtgtcgtcgggcgagggcgcggccgggatgagcccttctggcggacagaaatccttgtcgtccatgctcacttcttggccgaggccagccgtttgagggcctggcgcagggcggcggccacgtcaaggtcgggttcggcctccaggacctcggccgcgacctgccgggcctcgggttcgggatagccgaggttggtcagcccggccacgacgtcgccggccacgccgccggggatcggaaccgacggggccagcccggccgccggggcgcggccttcgagcttgtaggaaagctcgataaagatgcgctgggcgcttttcttgccgatacccggcacccgcaccagggcctcggcgtcgccggaggccaccacccgcagcagatcgtcggcggtgaaatgcgacaggatggccagggccgtgcgcgggccgagcttggagatgccgatgagcgtacggaaggtctcgcggtcgtcgaggctggcgaagccgaagagttccagggcgtcctcgcgcaccacggtatggacaaaaagcgaaacctggccgcccggggccggcaacgcggcggccaccggggtgggcagttccagttcgtagcccacgccgcccggggtgagcacgatggcaaaccggtcgcgccgggccacgacccggccttcgagatagccgatcatctggccccgcacaggcgggttagccgccgttgattgaggtggcacacggccgcagccagggcgtcggtggcgtccacggcgaaagtttcccgacatgccagcacccgcgccaccatgaaggccacctgggacttctcggcccgtcccgtgcccaccaggctttgcttgattacggtcggttcgtaggaatggacgctaaggccggccacggcgcaggcggccagggccgcgccccgggcctggccgagcttgagggccgtggcggcgtttttggagacaaagacgttttccaccgagacctcggccgggccgtggcgttggatgagttcggccacggcggtaaagatgacgcccaggcggctggggaaatcgggctggctggtcgttcgcaccacgccggcatccacgagttcgagcacgcccgagcgttcgcgcaccaggccatagcccgtggcccgcgagccgggatcgagtcccaggatgatgccgtcgccggtgtttgccatgccgtggtctaccgttttcgccaaagagaagaaagcccccagggcctcaaacaggaaccgggaggctaaccctcccggttcctgaacaatctccgtcacagtaccgccagcaccctttaccctttttcccaatcggggggtccgggggcctcaggcccccggccgccggaggcctcttcgctcttctcttacccaaacatctcgtcgggcagatcggcgttggagtggactttctggacgtcttcgttgtcttcgagcatgtcgataagtttgagcagcttctgaccggcttccaggtccagggccaccatgttggccggcaccatggccacttcggcgtcctcggagaccatgccggcggcttcgaaggcggcgcgcaggggttcgaagtcggccggggcgcaatgcacttcccagacctcgccttcatccatgatttcctcggccccgtgttccaggcccacttccatgagctggtcctcggtgaaggtcttggggaaggagaagacgcccttttgggagaacatccaggacacgcagccggattcgcccatggctccgccgcccttggacagcaggtggcgcacttcggccacggtacggttgcggttgtcggtggccgcttcgaccaggatggcgacgccgcccgggccgtagccttcgtagaggacttcttccaggttttcgccggcaagctcgccagtgcctttcttgatggcctgatcgatcttgtccttgggcaggttgacggccttggcggcggcgatggcggatttgaggcgctggttgagcgccgtgtcggccccgccagcccgggcggccagcatgagttccttggtcaccttggtgaaaaacttgctcttcttggcgtcctgcaccgacttgcgggcctggatgttatgccatttgctatgtccggccatggttcctcctggaaaaagtctcgggggttacccgtgtagtttgctgggtcatgtcgacggtccgggtggtcccggcccgctgccgccgcaaggggcgagggttggccccttggtcgcgcctattaaatgaagcgtcgcggctagtcgtttggcggcaagggcgagggggcgggatcgtcgggctggcccacgggggcagtgaagcccgtggccacgaagaagatttccttgctctcggcccgggagcttttgggcttggccacccgcacggcggaaaaatactggcgcagccccttctggaaggccggcgaatccggcccctgaaaaatcttgaccacgaacgcgccgccgggcttaagccgcgtgacagccacggacagggccgcctcgcacagctccaacgatctggcctggtcggtgaacttgtggccgatggtcttgggggccatgtcgcttagaacgacgtcaaaggggccgaagcgctcgaaggcctcggcgatgtccggcccgggttcgagcatgtcgccgataaggtaggtgacgttgcccggaaaggccgtggcggcggggttgaggtcgacggcgagcacccggccggacggccccacccgcttggcggcgtagagggaccaggagccggggcaggctccaagatcgaggacggccgcgccgggggtaagcaggcgcgattgtttttcgatctcctcgagtttatagacggagcgcgccggatagttatcctgcttggccttgttgaaatagtggtcgcggtacgttttcatgacgggcaacccggataccgtttaccggacaagctttcaaggaaaagacgccgccatggcccacatggaccgcccaaaccgcgccgtggtcatcgacgagaccggcgcacgccgcacactggccgccggggaagccgcctttgaggccctggcagcgggcgggcggccgctttttttgggcctgggacccgatccgggcgtcgccgtggccctggccggcgggcagccggccgactggctcgaatgcccggccttcgaggcggccatggggccggattggcttgcgcgcctgccggccggctggaaacgcctgaccccaggcgatctgacgcccgggcgcgtccgggccgcccgcgtgattttctatcgtcaaaacagccggctcttcccgtcattttgggggccggtcctggcccgcctccaactggctctgctccccgggccggaccgggccgcgcgcagccccggggtcatcctgccgcgcccggccaagggcctgcttgagccggaaatcgcccgggcgctgacggtgcttggccgaccggccctcgacatcgcccccgaagcctgcccggccgccctggccgccctgctctcccggcagacgccgtccgctctgctctccataaacggggccggcctggatgacgagggaatttccgccgcccttttggccgaggccggcgtgcccctggccatctggttcgtggacaacccgttccatgtactgggccggtttcgcggcggcttctggaagcgggcgctgctggccgtcaccgacgacagctttatcgaaccgttgcgccgtcttggggccgcccggaccctgcatctgccgcttggggcaagcgcccatttcttcgcggccgcgccgacgccggagctggccgacggggcggtctttgtcgggcgcagcgcctttgccgggcgcgatgcttttttcgccggctgccggctgccggacgggctgacggacacggcccgggccatggtcgcggccggcggccggccggactacttctggtgggcggaaaaactcggcttgggcgcgctttggcccggcaaggccggccgcgccgccgggctgggggccgagacagcctccctggccctgcgggccggggcgcttgccgccgtggccgaggctatgccgctggtcgtttacggcgacgaaggctggcgcgagcttttgcccgaaggcgtgtccctgttcccgccggtagattactacggcacgctgccgggcctctacgccgggggcggggtgacgctcaacgccaccagcctgctgcttccccgggggctcacccagcgccatttcgacgtctgggcggctggcggctgtcttgtcaccgacgcgaccccgggcctggacctgttcccggccgctctgaccgcgcccgtaagctacgctgcaccggggcaggccggaaagcttgccgccaacctgctggcccagccccaacgccgggccgatctggccgcgtcctggcgggaggccatcgccgccggccatcgctacgaacaccggctggccgccctgtttgcacggttgtcagacgacttctgacagcctgacgccactaccggcgtccgccttcacccgcgttctcctcccgtgaagccatgtcccctaaatcgcgaacgcaacacgccttctccgtccaggggcggttcccgacccaaggcgtatcccgcttatttgaccggcagccgccaggatggatcgtagcgcccctgccggggccggcgcgaggtgccgccgtgcagcccccggcgcacgaaatagagcagccgtttgctgaatttggccgcccaggcgtcgcaggccttgtcctggcggatgcgctcgaccagattctcggccccgccgggcaggcgctcgcgcttggcgatgcgccgccgcagggcgtagtgccccaactcatcgaccaggatcatggtcttgcgaaaatcccgaatcgagcggttgacgtaaatgtggtagcggccgtcgcgaaacagcaaaaaaccccagctatcaatgtcgtcgacctcggtgaccacgaggtcgacgcgtttgccggccatttccatgagcctggccagtaggcctgccataggcgctcctttgccggcacggggccgaccttccatggataagccttgcatccgggccgtcaagacgcgggcggccaggggcgatgcttgtgccgccaacgatggcatgataaccattttcaggcaattgcttgtcccgtaaacggccagacgtacccaaggcccgaccatggcgctcctcgaataccgaaactgcccccgctgcggccattcgacctggcaggaattcacgcccctggccgacgccgacagctcctactggcgctgccgcgactgcggcgaccggcgcgccgccaagcgcgtgcgcatcgaagaaaccgccctgctccaccggggacggctgcaaaccgccacgagctgcgccgacgtgctcatccgcgacttaagtcgcgacggcgcgcggctttgcctggacgaagacatgcccgtcgcacttgccgtggaccagaccgtggcctttaatccgcagctccagcccttcggcgaactggcccaatacatccccagcgtcgtgcgctggatcaagggccaggaattcggcctgctcttcacccgccccctggccatctcgtccggtgacatccggcgcatcgtcaagaattaggcccgccccgcccacccttcggccgttgcctccgccccaccaagggcgtatgctggatcagaccggaatcctccggccttccctcaacccaggcgcggcgcggttagcgatggactacgaaaagattcggcacgcggcaaagaccggcgacaagatcctcgaactggccgtctccatcggcctcgatccggcccgccacaccatccaggaactggccgaccggctgctggcccaggccctggccgaaagcggcgcggacgcgccgtgtaaataagtatggagagggaaacaaagaaaagatgcctccggcggccgggggatttaagagaccgttgcctctggcccatcagccagggggacaacagcgagcctacgcataggcaaaatgtctgcaaaaggggcctctccatctggagaggcccctttgcattccgggacaaggcttagttaatggccttgacctcggggaccttccaggtgttgttcaagatcgacggcgttttttccttgggccagtacatccgcagcatgagcacgaaggtgtccttgggcgcgggcagccagttcgactccttgtccgggccgggattctcgttttggatatacagatcgaccgaaccgtccgcattggccttgaggttgtcgcgagcgctgatgctctgccggttgatgggatttttgacgaaaaaataatccttgtcatacatcgtcagcgaccagaagccgtccaccggcggcagttggcccttgggaaaacgcatgacgtactttttttctccggaataggttccaaccaggctcgggccttccgacgtcggatacacggcgtcctgggacaggttggcccccaggccgtaataggtgaccatggcccgctggacgtagtccgtgccgtacgaaccgcacttgcccaggatcagccagccgttttcaaagcggttttcaccggtcaaaatgccttccttcatccacagcttgatgcgctcctgggccaccgtcggcacgatggccagggcgttcttggccaggggaccgagcttggcggcgtcaaacggcttgcccggttcgatgccgagcttggccaatttggcgaccatggccttgtcggccggcgcgggcggattgtccttgagaagcttggccagcagattgaagtagtccacggcgcttaaggcgttgacctgctcccggaccggggtgcgcatgtcgatggcgggatcgaccgtgaccggcggcggcgtgtagggcttgccgtaggaaccaagcggcaccgccgtaatggcgtcctgcatcttatgcacgaggtcgtaatcctcgggcgttccggtgcaatagatgcggccaagcacccagaccagggccgtcggcgacttgtactctttcactccggccggaagtttgcccttccagcccggcccggtaatggcatactgctgcggccccgttccggtggtgcgcttgcccggcgaggcaaagacgttggtccaggcgtcaagcatggggaagagatagtaccggccgctggcctccggcaggctgatcacccagggctccttggaaacgtcgagccaggtggtggtgtagagggtgtcggcgttgggggccgtcacctgccggtcttccacggcgggataggcccgcagccgcaggaactggcccatgggcgcagccatggcctccggtttggccacattggtgagcacgcgcttcgtcatttccatggtgaccagcggatagccgtagacatacgcttcgacggcaagaggcagagcctcgatgacattttccttggcctggacggatgttgcggccaggagggacaacacggcccacaggggcagcatccgtttaaacagtcggcacttcatgttgttacgctccttgcggttggaatgactcgaaaagacggcgctatccgccggatatgccttttgaccatcatccacatagcacggagccgtctccgacttccagaactttgcgagattgctgcccccgcgccacggtccgggatgacgccagggacggtcgccggcgacaaggcggccaagccgggccggaacatgtccgggacggcccgaacggtcttgccggaaaccgaaagcgtttgtctggaaacgcagggaagatggcgatgcggagcgctgtcaaaaggcaggtgcgctgcgggcagggctcagacgggccaagggaataaaaaccccgaagccctcgtccggcgttggcggcgcccgcccggggcgaagccggcggcggatgggatcgtctggcgtaagccgccgcccggggcgggcggcggcgttgattcaggcggccgttttcagccgccccggcgcggggcggcggccggcgcgggcgcgggcggcgtcttacgcggcgtccaggcgttgaccatggcctgcatggaatcgatctggcgcttgctcagggtggccccgatctggtcccgcagggcctgggccgcgctcttgtcctcggccggcgtgtccggcgcggccacggccaagagcgtccagaagtaggccttaaccggattggcctccacgcccttgccgtaaagctgcaaggtggccagcagatattgcgccccgcccttgccgccctgggccgcctcggtgagctgtttgaccgcttcctcgaaattctggggcacgccctggccgtagtaatagagcttgcccagacagtactgggcctcggggctgccggcggaggccgccttgcggaaccactccgccgccttggcgtaatcctgggccacgccctggcccatgtagtacatggccgcgatctggttttgcagggtcacgtcgcc
